(12) United States Patent
Hentschel et al.

(10) Patent No.: US 11,788,075 B2
(45) Date of Patent: Oct. 17, 2023

(54) ENGINEERED POLYMERASES WITH REDUCED SEQUENCE-SPECIFIC ERRORS

(71) Applicant: Element Biosciences, Inc., San Diego, CA (US)

(72) Inventors: Jendrik Hentschel, San Diego, CA (US); Tyler Lopez, Winchester, CA (US); Michael Klein, Encinitas, CA (US); Virginia Saade, San Diego, CA (US); Matthew Kellinger, San Diego, CA (US); Mark Ambroso, Escondido, CA (US)

(73) Assignee: ELEMENT BIOSCIENCES, INC., San Diego, CA (US)

( * ) Notice: Subject to any disclaimer, the term of this patent is extended or adjusted under 35 U.S.C. 154(b) by 0 days.

(21) Appl. No.: 18/160,947

(22) Filed: Jan. 27, 2023

(65) Prior Publication Data
US 2023/0265400 A1 Aug. 24, 2023

Related U.S. Application Data

(60) Provisional application No. 63/479,490, filed on Jan. 11, 2023, provisional application No. 63/343,036, filed on May 17, 2022, provisional application No. 63/311,939, filed on Feb. 18, 2022.

(51) Int. Cl.
*C12N 9/12* (2006.01)
*C12Q 1/6869* (2018.01)

(52) U.S. Cl.
CPC ......... *C12N 9/1252* (2013.01); *C12Q 1/6869* (2013.01); *C12Y 207/07007* (2013.01)

(58) Field of Classification Search
None
See application file for complete search history.

(56) References Cited

U.S. PATENT DOCUMENTS

| | | |
|---|---|---|
| 8,268,605 B2 | 9/2012 | Sorge et al. |
| 8,460,910 B2 | 6/2013 | Smith et al. |
| 8,852,910 B2 | 10/2014 | Smith et al. |
| 9,447,389 B2 | 9/2016 | Smith et al. |
| 9,677,057 B2 | 6/2017 | Bomati et al. |
| 10,017,750 B2 | 7/2018 | Smith et al. |
| 10,150,954 B2 | 12/2018 | Bomati et al. |
| 10,696,955 B2 | 6/2020 | Bomati et al. |
| 10,768,173 B1 | 9/2020 | Arslan et al. |
| 11,001,816 B2 | 5/2021 | Klausing et al. |
| 11,104,888 B2 | 8/2021 | Golynskiy et al. |
| 11,136,564 B2 | 10/2021 | Smith et al. |
| 11,198,854 B2 | 12/2021 | Bomati et al. |
| 11,220,707 B1 | 1/2022 | Arslan et al. |
| 11,377,644 B2 | 7/2022 | Kamtekar et al. |
| 2009/0247414 A1 | 10/2009 | Obradovic et al. |
| 2013/0165350 A1 | 6/2013 | Kuimelis et al. |
| 2013/0171631 A1 | 7/2013 | Becker et al. |
| 2014/0206550 A1 | 7/2014 | Bjornson et al. |
| 2020/0248258 A1 | 8/2020 | Arslan et al. |
| 2021/0079364 A1 | 3/2021 | Naji et al. |
| 2021/0348141 A1 | 11/2021 | Klausing et al. |
| 2022/0010290 A1 | 1/2022 | Smith et al. |
| 2022/0290216 A1 | 9/2022 | Middleton et al. |
| 2023/0087400 A1 | 3/2023 | Kamtekar et al. |

FOREIGN PATENT DOCUMENTS

| | | |
|---|---|---|
| WO | WO 2005/024010 A1 | 3/2005 |
| WO | WO 2009/131919 A2 | 10/2009 |
| WO | WO 2018/148727 A1 | 8/2018 |

OTHER PUBLICATIONS

Del Prado, A. et al. "New Insights into the Coordination Between the Polymerization and 3'-5' Exonuclease Activities in φ29 DNA Polymerase." Scientific Reports, vol. 9, Jan. 29, 2019, pp. 1-13.
Ngo, J. T. et al. "14: Computational Complexity, Protein Structure Prediction, and the Levinthal Paradox." The Protein Folding Problem and Tertiary Structure Prediction, Birkhauser, 1994, pp. 1-5.
PCT International Search Report and Written Opinion, PCT Application No. PCT/US2022/034021, dated Dec. 19, 2022, 26 pages.
PCT International Search Report and Written Opinion, PCT Application No. PCT/US2021/57441, dated Mar. 17, 2022, 17 pages.
PCT Invitation to Pay Additional Fees with Partial Search Report and Provisional Opinion, PCT Application No. PCT/US2022/034021, dated Oct. 28, 2022, 21 pages.
Uniprot. "A0A497RSY7 • A0A497RSY7_9ARCH." DNA Polymerase, Candidatus Altiarchaeales archaeon, Aug. 2020, 2 pages, [Online] [Retrieved Oct. 4, 2022], Retrieved from the Internet <URL:https://www.uniprot.org/uniprotkb/A0A497RSY7/entry>.
United States Office Action, U.S. Appl. No. 17/705,020, dated Aug. 31, 2022, 17 pages.
United States Office Action, U.S. Appl. No. 17/705,043, dated Jul. 27, 2022, 10 pages.

*Primary Examiner* — Suzanne M Noakes
*Assistant Examiner* — Jae W Lee
(74) *Attorney, Agent, or Firm* — Fenwick & West LLP

(57) ABSTRACT

Provided herein are engineered variants of archaeal polymerases that exhibit exonuclease-minus activity, enhanced thermostability, enhanced incorporation of 3' modified nucleotides, improved uracil-tolerance and/or reduce sequence-specific errors in polymerase-catalyzed nucleotide binding and extension reactions relative to wild type polymerase enzymes. Also provided are uses of the engineered polymerases for forming complexed polymerases and forming binding complexes, and uses for conducting nucleic acid sequencing reactions.

22 Claims, 213 Drawing Sheets
Specification includes a Sequence Listing.

Spacer: 
Linkers:
11 atom Linker: 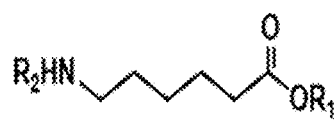
16 atom Linker: 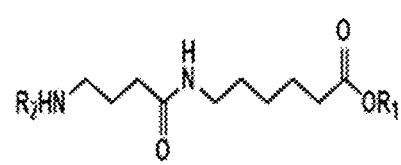
23 atom Linker: 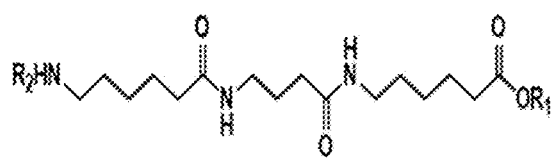
N3 Linker: 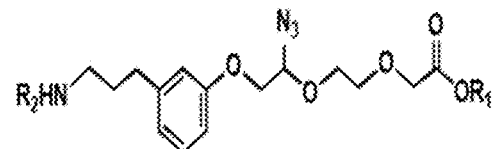
FIG. 7

Linker 1:
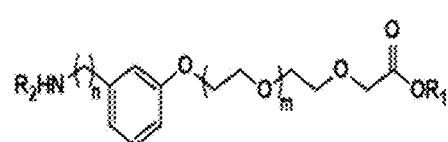
Linker 2:
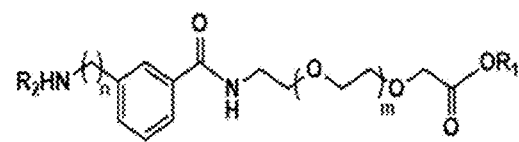
Linker 3:
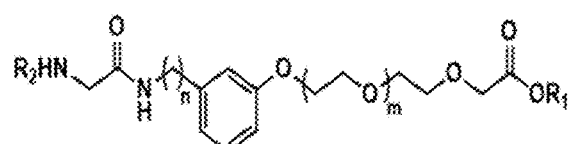
Linker 4:
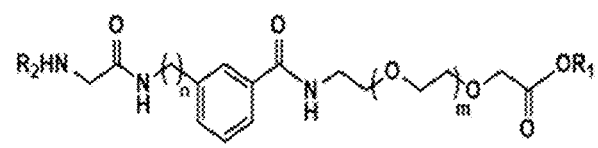
Linker 5:
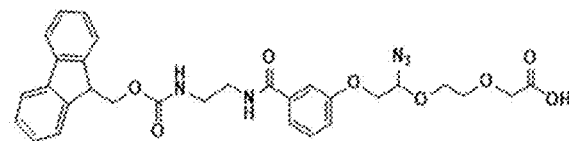
Linker 6:
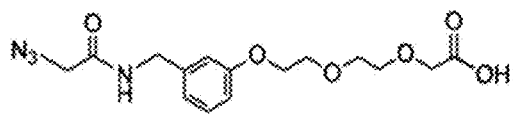
Molecular Weight: 352.35
Linker 7:
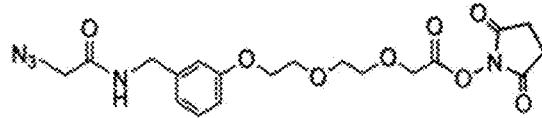
Molecular Weight: 449.42
Linker 8:
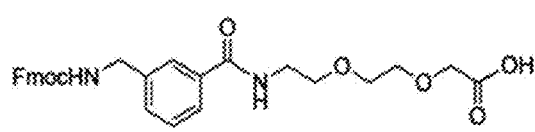
Molecular Weight: 518.57
Linker 9:
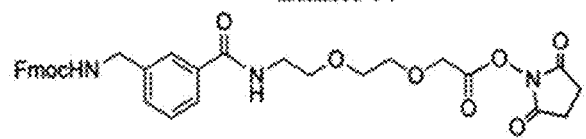
Molecular Weight: 615.64
FIG. 8 dNTP-PA-NH₂:
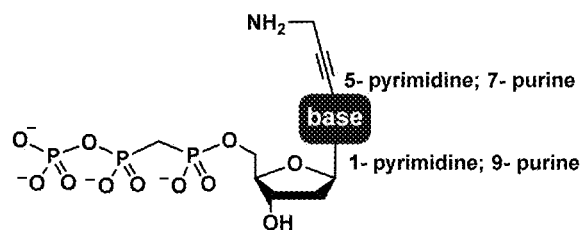
dNTP-PA-11 Atom Linker-NH₂:
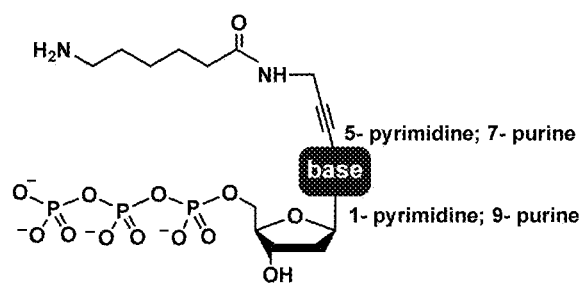
dNTP-PA-16 Atom Linker-NH₂:
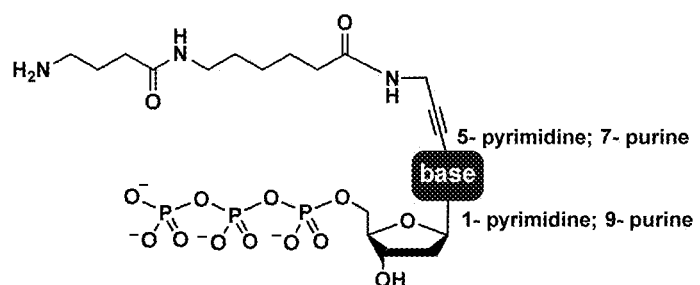
FIG. 9A dNTP-PA-23 Atom Linker-NH₂:
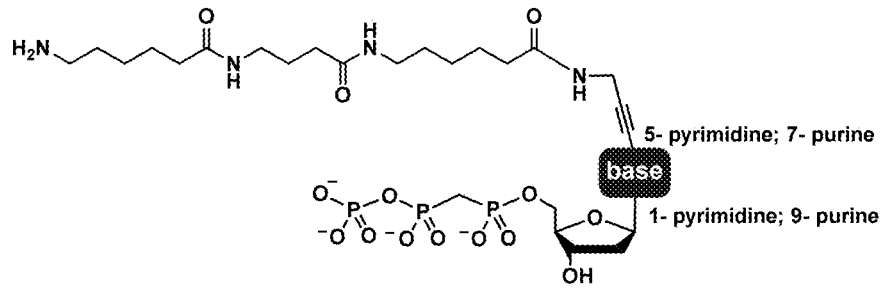
dNTP-PA-N3 Linker-NH₂:
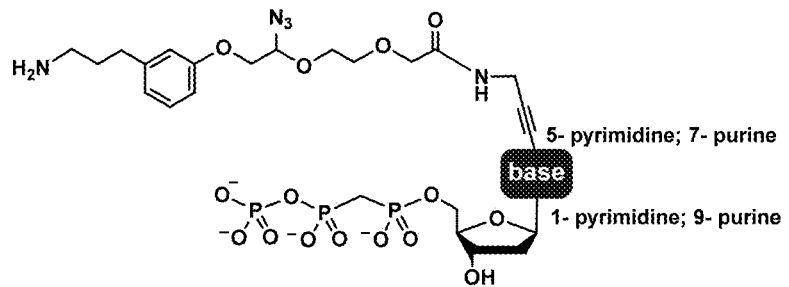
dNTP-PA-Linker 1-NH₂:
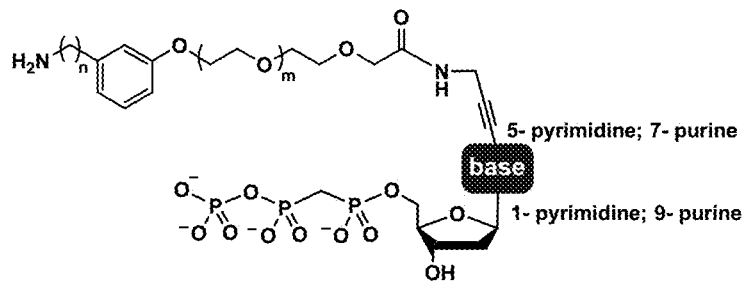
FIG. 9B dNTP-PA-Linker 2-NH₂:
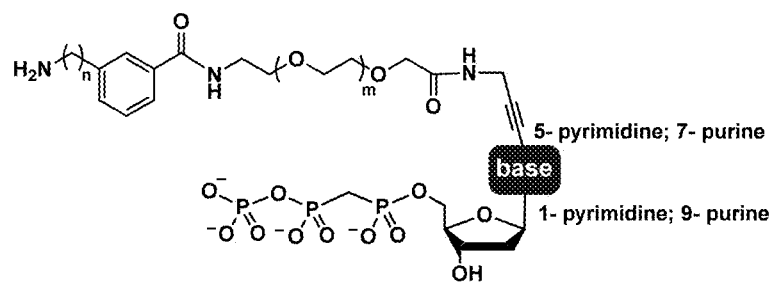
dNTP-PA-Linker 3-NH₂:
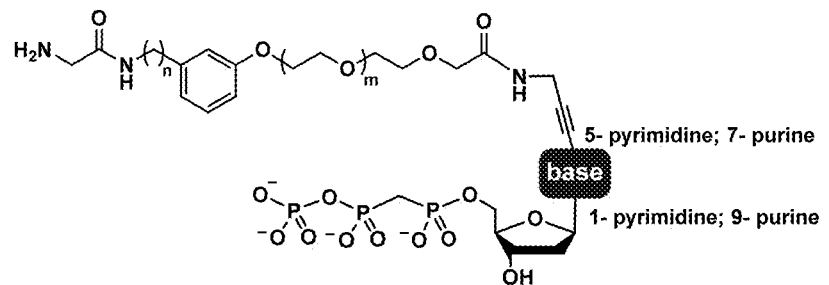
FIG. 9C dNTP-PA-Linker 4-NH₂:
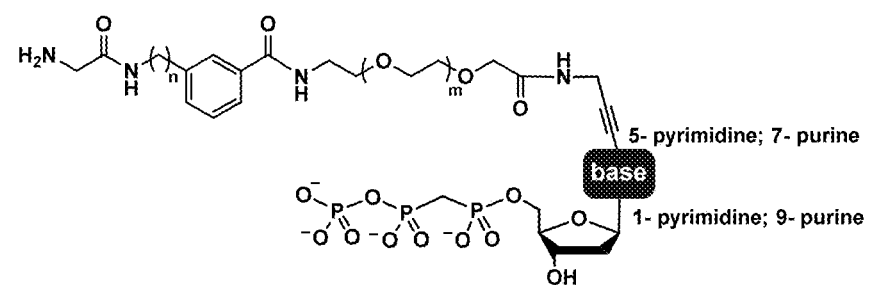
dNTP-PA-N3 Linker-NH₂:
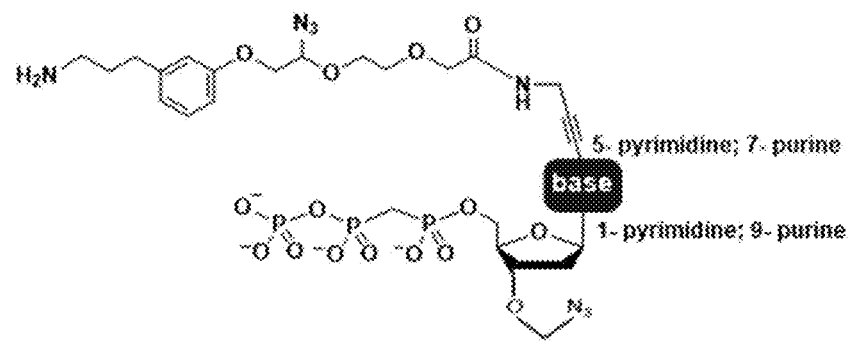
FIG. 9D

**Wild type DNA polymerase from Thermococci archaeon
GenBank accession RLF 89458.1; isolate B13_G1 (SEQ ID NO:1)**

MILDTDYITENGKPVIRIFKKEKGEFKIEYDRNFEPYIYALLEDDESIEDIKKITGERHG
KKVRIIRVEKVKKKFLGEPIEVWKLVFEHPQDVPAIRDAIRSHPAVREIFEYDIPFAKRY
LIDKGLVPMEGGEELKLLAFDIETFYHEGDEFAEGEILMISYADESGAKVITWKKIDLPY
VEVVSTEREAIKRFLQVLREKDPDVLLTYNGDNFDFAYIKKRCEKLGLKFTIGRDGSEPK
IQRMGDRFAVEVKGRIHLDLYPVVRHTIRLPTYTLEAVYEAVFGKKKEKVYAEEIAEAWK
SEEGLKRVAQYSMEDARATYELGREFFPMEVELAKLIGQSVWDVSRSSTGNLVEWYLLRV
AYERNELAPNKPGGEEYQRRMRSSYIGGYVKEPEKGLWESIAYLDFRSLYPSIIVTHNVS
PDTLEKECKNYDVAPIVGYRFCKDFKGFIPSILEDLIETRQKVKRKMKATIDPIEKKMLD
YRQRALKILANSYYGYQGYPKARWYSKECAESVTAWGRHYIETTIKEAEKFGFKVLYADT
DGFFATIPNEKPETIKSKAKKFLKHINEKLPGMLELEYEGFYLRGFFVTKKKYALIDEDG
HITTRGLEVVRRDWSEIAKETQAKVLEVILREGSIEKAAGIVKKVVEDLANYRVPVEKLI
IHEQITRELKDYKATGPHVAIAKRLQARGIKVKPGTIISYVVLKGSKKISDRVILFDEYD
SSRHKYDPDYYIHNQVLPAVLRILEAFGYKEKDLEYQRMKQTGLGAWLKMGKK

FIG. 11

**Wild type DNA polymerase from Thermococci archaeon
GenBank accession RLF 78286.1; isolate B89_G9 (SEQ ID NO:2)**

MILDTDYITENGKPVIRIFKKEKGEFKIEYDRNFEPYIYALLEDDESIEDIKKITGERHG
KKVRIIRVEKVKKKFLGEPIEVWKLVFEHPQDVPAIRDAIRSHPAVREIFEYDIPFAKRY
LIDKGLVPMEGGEELKLLAFDIETFYHEGDEFAEGEILMISYADESGAKVITWKKIDLPY
VEVVSTEREAIKRFLQVLREKDPDVLLTYNGDNFDFAYIKKRCEKLGLKFTIGREGSEPK
IQRMGDRFAVEVKGRIHLDLYPVVRHTIRLPTYTLEAVYEAVFGKKKEKVYAEEIAEAWK
SEEGLKRVAQYSMEDARATYELGREFFPMEVELAKLIGQSVWDVSRSSTGNLVEWYLLRV
AYERNELAPNKPGGEEYQRRMRSSYIGGYVKEPEKGLWESIAYLDFRSLYPSIIVTHNVS
PDTLEKECKNYDVAPIVGYRFCKDFKGFIPSILEDLIETRQKVKRKMKATIDPIEKKMLD
YRQRALKILANSYYGYQGYPKARWYSKECAESVTAWGRHYIETTIKEAEKFGFKVLYADT
DGFFATIPNEKPETIKSKAKKFLKHINEKLPGMLELEYEGFYLRGFFVTKKKYALIDEDG
HITTRGLEVVRRDWSEIAKETQAKVLEVILREGSIEKAAGIVKKVVEDLANYRVPVEKLI
IHEQITRELKDYKATGPHVAIAKRLQARGIKVKPGTIISYVVLKGSKKISDRVILFDEYD
SSRHKYDPDYYIHNQVLPAVLRILEAFGYKEKDLEYQRMKQTGLGAWLKMGKK

FIG. 12

**Wild type DNA polymerase from Euryarchaeota archaeon
GenBank accession NOZ 58130; isolate M_MaxBin.100 (SEQ ID NO:1316)**

MPRILKGFLIDADYETVEGRALIRLFLRGEEGSFVVYDDSFSPYFYALPGDEPERVKERI
LASGAAEAIQKVEIEEKRLFGTPRVALRITVSHPQDVPRIRERIRRVEGVDLILEHDILF
VRRYLIDRGIKPLTWLRLEVEERDGRALLRGVEQLEEEPPELRVAAVDIEVYNPKGAPRS
SKDEIIMISVATSDGVEKVLTWREVQGLEQVEVLQDEKEMLLRFAELIKEGDYDVIVGYN
TDSFDFPYIRDRLKKLGISLPLGRLDAELEVSRRGALPEARIRGRAHVDLYPIVRRHVKL
NSYVLESVVEELLGIKKEKLDGERLFTYWDEGGEKRALLARYALEDARVTLALAEKFLPL
YCELSTIVGQSLNDVARMTSGQLVEWLLMRYATPRGELIPNHPAGEEYAARARATYAGGY
VREPKRGLVEHIAVFDFRSLYPSIIVSHNIDPSTLIVGNCEENRAPELEYCFSLEREGFI
PAILKELIRRRAEIKRELKRSEGDRRRTLSFAEKALKILANSFYGYMGYPRARWYRRECA
ESVAAFARMYIKQVMRIAEEEFKLEVVYGDTDSLFVVIPPEKRELAQKFLQKVNESMPGI
IELEFEGFYRRGLFVTKKRYALLSEDGKMVVKGLEFVRRDWAPIARETQKEVLRILLEEA
DPEKAARLVRDVIERIRQRRVSLEDITIYTQLTKRIKSYKSLEPHVVAAQKLKERGREVA
PGMIIGYIITKGTKGISQRATPVEFARLEDYDPEYYIDNQILPAIQRIFEAIGYTRDYLK
EGITQTSLSRWF

FIG. 13

**Wild type DNA polymerase from Euryarchaeota archaeon
GenBank accession RMF 90817.1; isolate J060 (SEQ ID NO:2215)**

MARDLLLDIDYVTVDEKAQVRLFLKDKILFDPGFQPYFYVLAHDGAVEERLRDFGAVEAV
QRRMLGREMRFFKLILSHPSEVPKIREEVRSIEGVEGIFEHDILFARRYLIDKGLTPLNY
AEYRAEQGFLKGISSAGEGPESLRVMAFDIETYNPKGAPRAEKDPVIMLSLSTNTGLRRL
LTYKSGEGLDFVELVEDEKALLHRFKELVNEEGVEVLVGYNSDQFDLPYLVARAKALGVE
LPLGQDGSQPQIRKGRGLVESVVKGRPHVDLYPIVRRNVRLSSYVLENVVKEVLGREKEK
IPHDAMCGYWDRGGRELQRFMAYSMEDADVTLELAERFLPLYIELSRVVGLPLHDVARMT
AGQLVEWLLIREAFARGEVVPNKGSGREYLARSEDTYAGGYVMEPVKGIVENIVVFDFRS
LYPSIIVTHNIDPATLRPGRGENSPPELDYHFTTEEEGFIPSVLKRVLERRLSAKRRMKE
ARDPGEKRMLDISQRALKIIANSFYGYMGYPRARWYKKECAESVTSFARMYTKKVMAIAE
EEYGFKVVYGDTDSLFIVVQPEEKERAMSFMEDVNRRLPGTVELEYDGFYPRGIFITKKR
YALIDEKGNIVVKGLETVRRDWTRLSRDTQQKVLSVILREGDPKKAADIVKDTINRLKER
RVDLEDITIYTQLTKGIGRYKNVGPHVKAAQKAIDRGREVNPGMAIGYIIKKGRGLISDR
AEPVEDATIEDYDVDYYIENQVLPPVARIMEVLGYSKEHLKEEMVQGSLQRWF

FIG. 14

Wild type DNA polymerase from Hadesarchaea archaeon
GenBank accession MBC 7218772.1; isolate MAG-18 (SEQ ID NO:2367)

MRGLLFDVDIAEEEERPNVRLFVKVASETVVAIDPQFEEYFYVVADHPAKTSKLIEKIEL
DEGGRPIRPKSVEMVRRTLLGNEVEAIRVSFHQPRDAAKLRHKIRELPGVKEIYEFDIPP
ARRYLIDRGLTPMAGIEFSGSIEVRDGVKTVVMDGPPKPAPVEETRLNIMSFDIEVYNPT
GSVRPDKDPIIMISLADNRGLRKVITWKNFDKKPEYVEVVGSEREMIKKFVELVKERDVD
ILLGYNTDLFDLPYIRSRAKQLRVKLDLGRDGSELVVRKRRFATASKIRGRVHVDVFAMV
DFLATIGSIRLIHYSLADVYRHYAGREKPDFEFSEMINAWERGGDAGRRFLEYSMSDADA
TLEVGSELLPLFLGLTRVVGQTLFDVQRMTPGQLVEWLLVAEAHRIGELVPPRPVGEEFE
ERAEGTFTGAYVMEPVKGLHEDLVVFDFRSLYPSIIVTHNIDPSTLNCRDCKPGEREQVP
GLSYYFCKRRKGFIPAVLERVIEERTKLKAELKKIGRETREYRALDARQWAMKIVANSFY
GMLGYPRARWYSKQCAESVTSFGRHYIHRTIEMAREFGLEVVYGDTDSLHCKLNGKTREE
AMVFLRKVNESLPGIMELELEGFYPRGIFITKKRYAMVDDEGRMVVKGLEFVRRDWAAIA
KKTQEEVLRAILRDGSPKKAAEIIRKTTRDVYEGRVNLEDLIIYTQLKMPIESYKAIGPH
VVAAKRLRELGHEIEPGMMIAYIEVKGPGSISDRAVPVEDFEGKEYDPDYYVGHQILPAV
MRIMEVLGYSEEDLKFEREKQIGLDRFMK

FIG. 15

Wild type DNA polymerase from Thermococcus sp. 2319x1
GenBank accession WP 175059460.1 (SEQ ID NO:2393)

MILDTDYITKDGKPIIRIFKKENGEFKIELDPHFQPYIYALLKDDSAIEEIKAIKGERHG
KTVRVLDAVKVRKKFLGREVEVWKLIFEHPQDVPAMRDKIKEHPAVIDIYEYDIPFAKRY
LIDKGLIPMEGDEELKLLAFDIETFYHEGDEFGKGEIIMISYADEEEARVITWKNIDLPY
VDVVSNEREMIKRFVQVVKEKDPDVIITYNGDNFDLPYLIKRAEKLGIRLVLGRDKENPE
PKIQRMGDSFAVEIKGRIHFDLFPVVRRTINLPTYTLEAVYEAVLGKTKSKLGAEEIAAI
WETEESMKKLAQYSMEDARATYELGKEFFPMEAELAKLIGQSVWDVSRSSTGNLVEWYLL
RVAYARNELAPNKPDEEEYKRRLRTTYLGGYVKEPEKGLWENIIYLDFRSLYPSIIVTHN
VSPDTLEKEGCENYDIAPIVGYKFCKDFPGFIPSILGDLIAMRQEIKKKMKATIDPIEKK
MLDYRQRAVKLLANSYYGYMGYPKARWYSKECAESVTAWGRHYIEMTIKEIEEKFGFKVL
YADTDGFYATIPGEKPEIIKKKAREFLNYINSKLPGLLELEYEGFYLRGFFVTKKRYAVI
DEEGRITTRGLEVVRRDWSEIAKETQAKVLEAILKDGSVEKAVEIVRDVVEKIAKYRVPL
EKLVIHEQITRDLKDYKAIGPHVSIAKRLATRGIKVKPGTIISYLVLKGGGRISDRVILL
TEYDPEKHKYDPDYYIENQVLPAVLRILEAFGYRKEDLRYQSSKQTGLDAWLKR

FIG. 16

**Wild type DNA polymerase from Candidatus Hadarchaeum yellowstonense
GenBank accession KUO 42443.1; isolate YNP_45 (SEQ ID NO:2408)**

MLLDVDYAEEEEKPSIRLFVKTGSEVLVAIDPDFEEYFYVVSDHPAKASKLIEKVEVEED
GVSIRPKGVEIVKRTFLGNEVEAIKVSFYQAKDSSKLRHKIRELPGVREIYEFDIPPARR
YLIDRGLTPMAGVEFDGRIEERQGIKTVILDSPPRPAQVEEPKLNIMSFDIEVYNPTGSV
RPDKDPIIMISLADNNGLRKVITWKNFERSQEYVEVVGSEREMIKRFVDLVKERDVDILL
GYNTDLFDLPYIRSRAKQLKVKLDLGRDGSELVVRKRRFATASKIRGRIHVDVFAMVDFL
ATIGSIKLIHYSLADVYRHLLGKEKPDFEFTEMVDAWEKGGDAGRKFLEYSMSDADATLE
VGLELLPLFLGLTRVVGQTLFDVQRMTPGQLVEWLLVAEAHRIGELVPGRPVGEEYEERM
EETFVGAYVMEPVKGLHENLVVFDFRSLYPSIIVTHNIDPSTLNCKDCKPGEREQVPGLE
YYFCRRRKGFIPATLQRIIEERMKLKAELKKLVRGTKEYRALDARQWAMKIVANSFYGML
GYPRARWYSKECAESVTSFGRHYIHKTIDMAREFGLEVVYGDTDSLHCKLNGKTREEALA
FLKKVNDSLPGIMELELEGFYPRGIFITKKRYAMIDDEGRMVVKGLEFVRRDWAAIAKKT
QEEVLKAILRDGSPEKAAEIIRKTTRDVYEGRVNLEDLIIYTQLKMPIESYKAIGPHVVA
AKRLRELGHEIEPGMMIAYVEVKGPGSISERAVPVEDFKGREYDPDYYVGHQVLPAVMRI
MEVLGYREIDLKFERQRQVGLDRFMK

FIG. 17

**Wild type DNA polymerase from Euryarchaeota archaeon
GenBank accession NOZ 77387.1; isolate M_MaxBin.027 (SEQ ID NO:2436)**

MDGFLLDVDYKTVDEKPVVRLFLRDVIALDPSFRPYVYVACDDPRAVAGEIKDLELDGRR
PVTGVEEMERGLLGRPRRFLKVYLGHPQQVPRVRDLLRRLPGVSAVLEDDILFSRRYLID
KGLVPTAWVELQGRVEGSEFWVEEVRRAEGPLPRLKVMSFDIETYNPKGAPRGDQDPIIM
VSMATSGGLRKVLSWKAPTAGLEFVETLEDEAAVLRRFEELVRQEDPDILVGYNTDNFDF
PYLNQRLKALGIELALGRDGSPHKTSTRMGMSETRMAGRPHMDLYPIVRRSLRLPSYVLE
DVVAEVLGEEKEKVPGERMGEIWDKGGEELDRFFRYSLEDAEVTLRIGEKYLPLYIELSR
LVGQSIHDVARMTAGQLVEWYLMREAFARGEVIPERPGGREFARRAGDTYEGGYVREPRK
GLLEKVFDFRSLYPSVIVTHNIDPSTIRPGPGENQPPGIDYHFTTEKEGFIPALLKRLVA
RRAELKEEMKKARDPGERKMLDVQQQALKILANSFYGYMGYPRARWYRKECAESVTAFAR
DYIKKVMEVAEKEFGLEVVYGDTDSLFILVPGGKKERAFAFLEEVNRRLPGTIELEYEGF
YRRGIFVTKKRYALIDEKDRIIVKGLEFVRRDWAPIARDTQEKVLKALLKDASPEEAVRI
VRKAMDDIRARRVSLEDLTIYTQLTKK

FIG. 18

Wild type DNA polymerase from Geobacillus stearothermophilus (Bst polymerase) GenBank accession AAB52611.1 (SEQ ID NO:2502)

```
MKKKLVLIDGNSVAYRAFFALPLLHNDKGIHTNAVYGFTMMLNKILAEEQPTHLLVAFDA
GKTTFRHETFQEYKGGRQQTPPELSEQFPLLRELLKAYRIPAYELDHYEADDIIGTLAAR
AEQEGFEVKIISGDRDLTQLASRHVTVDITKKGITDIEPYTPETVREKYGLTPEQIVDLK
GLMGDKSDNIPGVPGIGEKTAVKLLKQFGTVENVLASIDEVKGEKLKENLRQHRDLALLS
KQLASICRDAPVELSLDDIVYEGQDREKVIALFKELGFQSFLEKMAAPAAEGEKPLEEME
FAIVDVITEEMLADKAALVVEVMEENYHDAPIVGIALVNEHGRFFMRPETALADSQFLAW
LADETKKKSMFDAKRAVVALKWKGIELRGVAFDLLLAAYLLNPAQDAGDIAAVAKMKQYE
AVRSDEAVYGKGVKRSLPDEQTLAEHLVRKAAAIWALEQPFMDDLRNNEQDQLLTKLEQP
LAAILAEMEFTGVNVDTKRLEQMGSELAEQLRAIEQRIYELAGQEFNINSPKQLGVILFE
KLQLPVLKKTKGYSTSADVLEKLAPHHEIVENILHYRQLGKLQSTYIEGLLKVVRPDTG
KVHTMFNQALTQTGRLSSAEPNLQNIPIRLEEGRKIRQAFVPSEPDWLIFAADYSQIELR
VLAHIADDDNLIEAFQRDLDIHTKTAMDIFHVSEEEVTANMRRQAKAVNFGIVYGISDYG
LAQNLNITRKEAAEFIERYFASFPGVKQYMENIVQEAKQKGYVTTLLHRRRYLPDITSRN
FNVRSFAERTAMNTPIQGSAADIIKKAMIDLAARLKEEQLQARLLLQVHDELILEAPKEE
IERLCELVPEVMEQAVTLRVPLKVDYHYGPTWYDAK
```

FIG. 19

9°N polymerase (SEQ ID NO:2503)

```
MILDTDYITENGKPVIRVFKKENGEFKIEYDRTFEPYFYALLKDDSAIEDVKKVTAKRHG
TVVKVKRAEKVQKKFLGRPIEVWKLYFNHPQDVPAIRDRIRAHPAVVDIYEYDIPFAKRY
LIDKGLIPAEGDEELTMLAFDIETLYHEGEEFGTGPILMISYADGSEARVITWKKIDLPY
VDVVSTEKEMIKRFLRVVREKDPDVLITYNGDNFDFAYLKKRCEELGIKFTLGRDGSEPK
IQRMGDRFAVEVKGRIHFDLYPVIRRTINLPTYTLEAVYEAVFGKPKEKVYAEEIAQAWE
SGEGLERVARYSMEDAKVTYELGREFFPMEAQLSRLIGQSLWDVSRSSTGNLVEWFLLRK
AYKRNELAPNKPDERELARRRGGYAGGYVKEPERGLWDNIVYLDFRSLYPSIIITHNVSP
DTLNREGCKEYDVAPEVGHKFCKDFPGFIPSLLGDLLEERQKIKRKMKATVDPLEKKLLD
YRQRAIKILANSFYGYYGYAKARWYCKECAESVTAWGREYIEMVIRELEEKFGFKVLYAD
TDGLHATIPGADAETVKKKAKEFLKYINPKLPGLLELEYEGFYVRGFFVTKKKYAVIDEE
GKITTRGLEIVRRDWSEIAKETQARVLEAILKHGDVEEAVRIVKEVTEKLSKYEVPPEKL
VIHEQITRDLRDYKATGPHVAVAKRLAARGVKIRPGTVISYIVLKGSGRIGDRAIPADEF
DPTKHRYDAEYYIENQVLPAVERILKAFGYRKEDLRYQKTKQVGLGAWLKVKGKK
```

FIG. 20

9°N polymerase
UniProtKB - Q56366 (DPOL_THES9) (SEQ ID NO:2504)

MILDTDYITENGKPVIRVFKKENGEFKIEYDRTFEPYFYALLKDDSAIEDVKKVTAKRHG
TVVKVKRAEKVQKKFLGRPIEVWKLYFNHPQDVPAIRDRIRAHPAVVDIYEYDIPFAKRY
LIDKGLIPMEGDEELTMLAFDIETLYHEGEEFGTGPILMISYADGSEARVITWKKIDLPY
VDVVSTEKEMIKRFLRVVREKDPDVLITYNGDNFDFAYLKKRCEELGIKFTLGRDGSEPK
IQRMGDRFAVEVKGRIHFDLYPVIRRTINLPTYTLEAVYEAVFGKPKEKVYAEEIAQAWE
SGEGLERVARYSMEDAKVTYELGREFFPMEAQLSRLIGQSLWDVSRSSTGNLVEWFLLRK
AYKRNELAPNKPDERELARRRGGYAGGYVKEPERGLWDNIVYLDFRSLYPSIIITHNVSP
DTLNREGCKEYDVAPEVGHKFCKDFPGFIPSLLGDLLEERQKIKRKMKATVDPLEKKLLD
YRQRAIKILANSFYGYYGYAKARWYCKECAESVTAWGREYIEMVIRELEEKFGFKVLYAD
TDGLHATIPGADAETVKKKAKEFLKYINPKLPGLLELEYEGFYVRGFFVTKKKYAVIDEE
GKITTRGLEIVRRDWSEIAKETQARVLEAILKHGDVEEAVRIVKEVTEKLSKYEVPPEKL
VIHEQITRDLRDYKATGPHVAVAKRLAARGVKIRPGTVISYIVLKGSGRIGDRAIPADEF
DPTKHRYDAEYYIENQVLPAVERILKAFGYRKEDLRYQKTKQVGLGAWLKVKGKK

FIG. 21

Therminator polymerase (SEQ ID NO:2505)

MILDTDYITENGKPVIRVFKKENGEFKIEYDRTFEPYFYALLKDDSAIEDVKKVTAKRHG
TVVKVKRAEKVQKKFLGRPIEVWKLYFNHPQDVPAIRDRIRAHPAVVDIYEYDIPFAKRY
LIDKGLIPMEGDEELTMLAFAIATLYHEGEEFGTGPILMISYADGSEARVITWKKIDLPY
VDVVSTEKEMIKRFLRVVREKDPDVLITYNGDNFDFAYLKKRCEELGIKFTLGRDGSEPK
IQRMGDRFAVEVKGRIHFDLYPVIRRTINLPTYTLEAVYEAVFGKPKEKVYAEEIAQAWE
SGEGLERVARYSMEDAKVTYELGREFFPMEAQLSRLIGQSLWDVSRSSTGNLVEWFLLRK
AYKRNELAPNKPDERELARRRGGYAGGYVKEPERGLWDNIVYLDFRSLYPSIIITHNVSP
DTLNREGCKEYDVAPEVGHKFCKDFPGFIPSLLGDLLEERQKIKRKMKATVDPLEKKLLD
YRQRLIKILANSFYGYYGYAKARWYCKECAESVTAWGREYIEMVIRELEEKFGFKVLYAD
TDGLHATIPGADAETVKKKAKEFLKYINPKLPGLLELEYEGFYVRGFFVTKKKYAVIDEE
GKITTRGLEIVRRDWSEIAKETQARVLEAILKHGDVEEAVRIVKEVTEKLSKYEVPPEKL
VIHEQITRDLRDYKATGPHVAVAKRLAARGVKIRPGTVISYIVLKGSGRIGDRAIPADEF
DPTKHRYDAEYYIENQVLPAVERILKAFGYRKEDLRYQKTKQVGLGAWLKVKGKK

FIG. 22

Vent polymerase UniProtKB - P30317 (DPOL_THELI) (SEQ ID NO:2506)

```
MILDTDYITKDGKPIIRIFKKENGEFKIELDPHFQPYIYALLKDDSAIEEIKAIKGERHG
KTVRVLDAVKVRKKFLGREVEVWKLIFEHPDVPAMRGKIREHPAVVDIYEYDIPFAKRY
LIDKGLIPMEGDEELKLLAFDIETFYHEGDEFGKGEIIMISYADEEEARVITWKNIDLPY
VDVVSNEREMIKRFVQVVKEKDPDVIITYNGDNFDLPYLIKRAEKLGVRLVLGRDKEHPE
PKIQRMGDSFAVEIKGRIHFDLPVVRRTINLPTYTLEAVYEAVLGKTKSKLGAEEIAAI
WETEESMKKLAQYSMEDARATYELGKEFFPMEAELAKLIGQSVWDVSRSSTGNLVEWYLL
RVAYARNELAPNKPDEEEYKRRLRTTYLGGYVKEPEKGLWENIIYLDFRSLYPSIIVTHN
VSPDTLEKEGCKNYDVAPIVGYRFCKDFPGFIPSILGDLIAMRQDIKKKMKSTIDPIEKK
MLDYRQRAIKLLANSILPNEWLPIIENGEIKFVKIGEFINSYMEKQKENVKTVENTEVLE
VNNLFAFSFNKKIKESEVKKVKALIRHKYKGKAYEIQLSSGRKINITAGHSLFTVRNGEI
KEVSGDGIKEGDLIVAPKKIKLNEKGVSINIPELISDLSEEETADIVMTISAKGRKNFFK
GMLRTLRWMFGEENRRIRTFNRYLFHLEKLGLIKLLPRGYEVTDWERLKKYKQLYEKLAG
SVKYNGNKREYLVMFNEIKDFISYFPQKELEEWKIGTLNGFRTNCILKVDEDFGKLLGYY
VSEGYAGAQKNKTGGISYSVKLYNEDPNVLESMKNVAEKFFGKVRVDRNCVSISKKMAYL
VMKCLCGALAENKRIPSVILTSPEPVRWSFLEAYFTGDGDIHPSKRFRLSTKSELLANQL
VFLLNSLGISSVKIGFDSGVYRVYINEDLQFPQTSREKNTYYSNLIPKEILRDVFGKEFQ
KNMTFKKFKELVDSGKLNREKAKLLEFFINGDIVLDRVKSVKEKDYEGYVYDLSVEDNEN
FLVGFGLLYAHNSYYGYMGYPKARWYSKECAESVTAWGRHYIEMTIREIEEKFGFKVLYA
DSVSGESEIIIRQNGKIRFVKIKDLFSKVDYSIGEKEYCILEGVEALTLDDDGKLVWKPV
PYVMRHRANKRMFRIWLTNSWYIDVTEDHSLIGYLNTSKTKTAKKIGERLKEVKPFELGK
AVKSLICPNAPLKDENTKTSEIAVKFWELVGLIVGDGNWGGDSRWAEYYLGLSTGKDAEE
IKQKLLEPLKTYGVISNYYPKNEKGDFNILAKSLVKFMKRHFKDEKGRRKIPEFMYELPV
TYIEAFLRGLFSADGTVTIRKGVPEIRLTNIDADFLREVRKLLWIVGISNSIFAETTPNR
YNGVSTGTYSKHLRIKNKWRFAERIGFLIERKQKRLLEHLKSARVKRNTIDFGFDLHVK
KVEEIPYEGYVYDIEVEETHRFFANNILVHNTDGFYATIPGEKPELIKKKAKEFLNYINS
KLPGLLELEYEGFYLRGFFVTKKRYAVIDEEGRITTRGLEVVRRDWSEIAKETQAKVLEA
ILKEGSVEKAVEVVRDVVEKIAKYRVPLEKLVIHEQITRDLKDYKAIGPHVAIAKRLAAR
GIKVKPGTIISYIVLKGSGKISDRVILLTEYDPRKHKYDPDYYIENQVLPAVLRILEAFG
YRKEDLRYQSSKQTGLDAWLKR
```

FIG. 23

Deep Vent polymerase UniProtKB - Q51334 (DPOL_PYRSD) (SEQ ID NO:2507)

MILDADYITEDGKPIIRIFKKENGEFKVEYDRNFRPYIYALLKDDSQIDEVRKITAERHG
KIVRIIDAEKVRKKFLGRPIEVWRLYFEHPQDVPAIRDKIREHSAVIDIFEYDIPFAKRY
LIDKGLIPMEGDEELKLLAFDIETLYHEGEEFAKGPIIMISYADEEEAKVITWKKIDLPY
VEVVSSEREMIKRFLKVIREKDPDVIITYNGDSFDLPYLVKRAEKLGIKLPLGRDGSEPK
MQRLGDMTAVEIKGRIHFDLYHVIRRTINLPTYTLEAVYEAIFGKPKEKVYAHEIAEAWE
TGKGLERVAKYSMEDAKVTYELGREFFPMEAQLSRLVGQPLWDVSRSSTGNLVEWYLLRK
AYERNELAPNKPDEREYERRLRESYAGGYVKEPEKGLWEGLVSLDFRSLYPSIIITHNVS
PDTLNREGCREYDVAPEVGHKFCKDFPGFIPSLLKRLLDERQEIKRKMKASKDPIEKKML
DYRQRAIKILANSILPEEWVPLIKNGKVKIFRIGDFVDGLMKANQGKVKKTGDTEVLEVA
GIHAFSFDRKSKKARVMAVKAVIRHRYSGNVYRIVLNSGRKITITEGHSLFVYRNGDLVE
ATGEDVKIGDLLAVPRSVNLPEKRERLNIVELLLNLSPEETEDIILTIPVKGRKNFFKGM
LRTLRWIFGEEKRVRTASRYLRHLENLGYIRLRKIGYDIIDKEGLEKYRTLYEKLVDVVR
YNGNKREYLVEFNAVRDVISLMPEEELKEWRIGTRNGFRMGTFVDIDEDFAKLLGYYVSE
GSARKWKNQTGGWSYTVRLYNENDEVLDDMEHLAKKFFGKVKRGKNYVEIPKKMAYIIFE
SLCGTLAENKRVPEVIFTSSKGVRWAFLEGYFIGDGDVHPSKRVRLSTKSELLVNGLVLL
LNSLGVSAIKLGYDSGVYRVYVNEELKFTEYRKKKNVYHSHIVPKDILKETFGKVFQKNI
SYKKFRELVENGKLDREKAKRIEWLLNGDIVLDRVVEIKREYYDGYVYDLSVDEDENFLA
GFGFLYAHNSYYGYYGYAKARWYCKECAESVTAWGREYIEFVRKELEEKFGFKVLYIDTD
GLYATIPGAKPEEIKKKALEFVDYINAKLPGLLELEYEGFYVRGFFVTKKKYALIDEEGK
IITRGLEIVRRDWSEIAKETQAKVLEAILKHGNVEEAVKIVKEVTEKLSKYEIPPEKLVI
YEQITRPLHEYKAIGPHVAVAKRLAARGVKVRPGMVIGYIVLRGDGPISKRAILAEEFDL
RKHKYDAEYYIENQVLPAVLRILEAFGYRKEDLRWQKTKQTGLTAWLNIKKK

FIG. 24

Pfu polymerase UniProtKB - P61875 (DPOL_PYRFU) (SEQ ID NO:2508)

MILDVDYITEEGKPVIRLFKKENGKFKIEHDRTFRPYIYALLRDDSKIEEVKKITGERHG
KIVRIVDVEKVEKKFLGKPITVWKLYLEHPQDVPTIREKVREHPAVVDIFEYDIPFAKRY
LIDKGLIPMEGEEELKILAFDIETLYHEGEEFGKGPIIMISYADENEAKVITWKNIDLPY
VEVVSSEREMIKRFLRIIREKDPDIIVTYNGDSFDFPYLAKRAEKLGIKLTIGRDGSEPK
MQRIGDMTAVEVKGRIHFDLYHVITRTINLPTYTLEAVYEAIFGKPKEKVYADEIAKAWE
SGENLERVAKYSMEDAKATYELGKEFLPMEIQLSRLVGQPLWDVSRSSTGNLVEWFLLRK
AYERNEVAPNKPSEEEYQRRLRESYTGGFVKEPEKGLWENIVYLDFRALYPSIIITHNVS
PDTLNLEGCKNYDIAPQVGHKFCKDIPGFIPSLLGHLLEERQKIKTKMKETQDPIEKILL
DYRQKAIKLLANSFYGYYGYAKARWYCKECAESVTAWGRKYIELVWKELEEKFGFKVLYI
DTDGLYATIPGGESEEIKKKALEFVKYINSKLPGLLELEYEGFYKRGFFVTKKRYAVIDE
EGKVITRGLEIVRRDWSEIAKETQARVLETILKHGDVEEAVRIVKEVIQKLANYEIPPEK
LAIYEQITRPLHEYKAIGPHVAVAKKLAAKGVKIKPGMVIGYIVLRGDGPISNRAILAEE
YDPKKHKYDAEYYIENQVLPAVLRILEGFGYRKEDLRYQKTRQVGLTSWLNIKKS

FIG. 25

Pyrococcus abyssi polymerase UniProtKB - P0CL77 (DPOL_PYRAB) (SEQ ID NO:2509)

MIIDADYITEDGKPIIRIFKKEKGEFKVEYDRTFRPYIYALLKDDSAIDEVKKITAERHG
KIVRITEVEKVQKKFLGRPIEVWKLYLEHPQDVPAIREKIREHPAVVDIFEYDIPFAKRY
LIDKGLTPMEGNEELTFLAVDIETLYHEGEEFGKGPIIMISYADEEGAKVITWKSIDLPY
VEVVSSEREMIKRLVKVIREKDPDVIITYNGDNFDFPYLLKRAEKLGIKLPLGRDNSEPK
MQRMGDSLAVEIKGRIHFDLPVIRRTINLPTYTLEAVYEAIFGKSKEKVYAHEIAEAWE
TGKGLERVAKYSMEDAKVTFELGKEFFPMEAQLARLVGQPVWDVSRSSTGNLVEWFLLRK
AYERNELAPNKPDEREYERRLRESYEGGYVKEPEKGLWEGIVSLDFRSLYPSIIITHNVS
PDTLNRENCKEYDVAPQVGHRFCKDFPGFIPSLLGNLLEERQKIKKRMKESKDPVEKKLL
DYRQRAIKILANSYYGYYGYAKARWYCKECAESVTAWGRQYIDLVRRELESRGFKVLYID
TDGLYATIPGAKHEEIKEKALKFVEYINSKLPGLLELEYEGFYARGFFVTKKKYALIDEE
GKIVTRGLEIVRRDWSEIAKETQAKVLEAILKHGNVDEAVKIVKEVTEKLSKYEIPPEKL
VIYEQITRPLSEYKAIGPHVAVAKRLAAKGVKVKPGMVIGYIVLRGDGPISKRAIAIEEF
DPKKHKYDAEYYIENQVLPAVERILRAFGYRKEDLKYQKTKQVGLGAWLKF

FIG. 26

RB69 polymerase UniProtKB - Q38087 (DPOL_BPR69) (SEQ ID NO:2510)

MKEFYLTVEQIGDSIFERYIDSNGRERTREVEYKPSLFAHCPESQATKYFDIYGKPCTRK
LFANMRDASQWIKRMEDIGLEALGMDDFKLAYLSDTYNYEIKYDHTKIRVANFDIEVTSP
DGFPEPSQAKHPIDAITHYDSIDDRFYVFDLLNSPYGNVEEWSIEIAAKLQEQGGDEVPS
EIIDKIIYMPFDNEKELLMEYLNFWQQKTPVILTGWNVESFDIPYVYNRIKNIFGESTAK
RLSPHRKTRVKVIENMYGSREIITLFGISVLDYIDLYKKFSFTNQPSYSLDYISEFELNV
GKLKYDGPISKLRESNHQRYISYNIIDVYRVLQIDAKRQFINLSLDMGYYAKIQIQSVFS
PIKTWDAIIFNSLKEQNKVIPQGRSHPVQPYPGAFVKEPIPNRYKVMSFDLTSLYPSII
RQVNISPETIAGTFKVAPLHDYINAVAERPSDVYSCSPNGMMYYKDRDGVVPTEITKVFN
QRKEHKGYMLAAQRNGEIIKEALHNPNLSVDEPLDVDYRFDFSDEIKEKIKKLSAKSLNE
MLFRAQRTEVAGMTAQINRKLLINSLYGALGNVWFRYYDLRNATAITTFGQMALQWIERK
VNEYLNEVCGTEGEAFVLYGDTDSIYVSADKIIDKVGESKFRDTNHWVDFLDKFARERME
PAIDRGFREMCEYMNNKQHLMFMDREAIAGPPLGSKGIGGFWTGKKRYALNVWDMEGTRY
AEPKLKIMGLETQKSSTPKAVQKALKECIRRMLQEGEESLQEYFKEFEKEFRQLNYISIA
SVSSANNIAKYDVGGFPGPKCPFHIRGILTYNRAIKGNIDAPQVVEGEKVYVLPLREGNP
FGDKCIAWPSGTEITDLIKDDVLHWMDYTVLLEKTFIKPLEGFTSAAKLDYEKKASLFDM
FDF

FIG. 27

Phi29 DNA polymerase UniProtKB/Swiss-Prot: P03680.1 (SEQ ID NO:2455)

MKHMPRKMYSCDFETTTKVEDCRVWAYGYMNIEDHSEYKIGNSLDEFMAWVLKVQADLYF
HNLKFDGAFIINWLERNGFKWSADGLPNTYNTIISRMGQWYMIDICLGYKGKRKIHTVIY
DSLKKLPFPVKKIAKDFKLTVLKGDIDYHKERPVGYKITPEEYAYIKNDIQIIAEALLIQ
FKQGLDRMTAGSDSLKGFKDIITTKKFKKVFPTLSLGLDKEVRYAYRGGFTWLNDRFKEK
EIGEGMVFDVNSLYPAQMYSRLLPYGEPIVFEGKYVWDEDYPLHIQHIRCEFELKEGYIP
TIQIKRSRFYKGNEYLKSSGGEIADLWLSNVDLELMKEHYDLYNVEYISGLKFKATTGLF
KDFIDKWTYIKTTSEGAIKQLAKLMLNSLYGKFASNPDVTGKVPYLKENGALGFRLGEEE
TKDPVYTPMGVFITAWARYTTITAAQACYDRIIYCDTDSIHLTGTEIPDVIKDIVDPKKL
GYWAHESTFKRAKYLRQKTYIQDIYMKEVDGKLVEGSPDDYTDIKFSVKCAGMTDKIKKE
VTFENFKVGFSRKMKPKPVQVPGGVVLVDDTFTIK

FIG. 28

Table 1: Wild type RLF 89458.1 = SEQ ID NO:1; wild type RLF 78286 = SEQ ID NO:2

| SEQ#: | Mutations based on SEQ ID NOS: 1 or 2 | Incorp'n |
|---|---|---|
| 3 | Y7F_D141A_E143A_Y261A_L409S_Y410A_A485S_C509V | ++ |
| 4 | D141A_E143A_Y261A_L409Y_Y410A_T514S | ++ |
| 5 | Y7F_D141A_E143A_Y261A_L409S_Y410A_P411G_A485S | + |
| 6 | I48V_K52R_G77D_V86A_D141A_E143A_Y261A_L409S_Y410A_P411G | ++ |
| 7 | D141A_E143A_Y261A_L409S_Y410A_P411G_G676S | 0 |
| 8 | I65V_I66V_I96K_E111G_E130V_D141A_E143A_Y261A_L409S_Y410A_P411G | + |
| 9 | D141A_E143A_Y261A_L409Y_Y410A_P411I | 0 |
| 10 | I51K_K61M_P79S_D141A_E143A_Y261A_L409S_Y410A_P411G | + |
| 11 | P115R_D141A_E143A_Y261A_L409S_Y410A_P411G | 0 |
| 12 | G56D_K70I_R119C_L135P_D141A_E143A_Y261A_L409S_Y410A_P411G | + |
| 13 | D141A_E143A_Y261A_L409F_Y410G | + |
| 14 | D141A_E143A_Y261A_L409S_Y410A_P411G_K561N_G572S_M573I_G585D | + |
| 15 | D141A_E143A_Y261A_L409S_Y410A_P411G_A650T_D720Y | 0 |
| 16 | E29V_R67C_P94S_D113G_D141A_I142F_E143A_Y261A_L409S_Y410A_P411G | + |
| 17 | D141A_E143A_Y261A_L409S_Y410A_P411G_I714F_Y756F | 0 |
| 18 | D141A_E143A_Y261A_L409S_Y410A_P411G_Y652H_V654M_D671G_D717N_D753E | ++ |
| 19 | E35K_K73E_D92V_R101H_D141A_E143A_Y261A_L409S_Y410A_P411G | + |

FIG. 29A

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 20 | F34I_Q91R_R97H_D141A_E143A_Y261A_L409S_Y410A_P411G | + |
| 21 | D141A_E143A_Y261A_L409F_Y410A | ++ |
| 22 | D141A_E143A_Y261A_L409F_Y410A_P411G | 0 |
| 23 | V93M_G131S_D141A_E143A_Y261A_L409S_Y410A_P411G | + |
| 24 | D141A_E143A_Y261A_L409Y_Y410A_T514A | ++ |
| 25 | P94F_D141A_E143A_Y261A_L409S_Y410A_P411G | 0 |
| 26 | D141A_E143A_Y261A_L409S_Y410A_P411G_K637M_V646A_D720V_F747L_D753V | ++ |
| 27 | Y7A_D141A_E143A_Y261A_L409S_Y410A | ++ |
| 28 | Y7F_D141A_E143A_Y261A_L409S_Y410A_P411G_A485S_K507L | + |
| 29 | I65N_F87C_P94S_A99T_M129L_D141A_E143A_Y261A_L409S_Y410A_P411G | + |
| 30 | E22G_I54T_V63A_D92N_K124N_D141A_E143A_Y261A_L409S_Y410A_P411G | 0 |
| 31 | R58C_V68M_P90L_A99T_K136R_D141A_E143A_Y261A_L409S_Y410A_P411G | + |
| 32 | D141A_E143A_Y261A_L409Y_Y410G | ++ |
| 33 | D141A_E143A_Y261A_L409Y_Y410A_P411V | 0 |
| 34 | D141A_E143A_K240S_Y261A_L409S_Y410A_P411G | 0 |
| 35 | E78G_I109N_E111V_D123N_E130V_D141A_E143A_Y261A_L409S_Y410A_P411G | + |
| 36 | D141A_E143A_Y261A_S347N_G373S_L404Q_L409S_Y410A_P411G_L424Q_F448I_V463M | + |
| 37 | D141A_E143A_Y261A_L409A_Y410G_T514G | ++ |
| 38 | D141A_E143A_Y261A_L409S_Y410G_P411I | 0 |

FIG. 29B

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 39 | H89D_I96T_L137F_D141A_E143A_Y261A_L409S_Y410A_P411G | ++ |
| 40 | K52I_D141A_E143A_Y261A_L409S_Y410A_P411G | + |
| 41 | D141A_E143A_Y261A_L409S_Y410A_P411G_I521N | 0 |
| 42 | D141A_E143A_Y261A_L409S_Y410A_P411G_G585A | 0 |
| 43 | D141A_E143A_Y261A_L409S_Y410A_P411G_H678K | 0 |
| 44 | D141A_E143A_Y261A_L409A_Y410G_P411G_T514A | ++ |
| 45 | D141A_E143A_Y261A_Q378R_F406Y_L409S_Y410A_P411G_T423I_A485T_Q497H | + |
| 46 | Y7F_A117V_D141A_E143A_Y261A_L409S_Y410A_V415R_A434D_A485S_K507L_I521H | ++ |
| 47 | G12E_D141A_E143A_Y261A_L409S_Y410A_P411G | 0 |
| 48 | D141A_E143A_Y261A_L409S_Y410A_P411G_H678R | 0 |
| 49 | E78N_D141A_E143A_Y261A_L409S_Y410A_V415K_A434D_A485S_S492G_K507L_I521T_D671R | ++ |
| 50 | Y7F_E78S_D141A_E143A_Y261A_L409S_Y410A_P411G_V415R_A485S | + |
| 51 | E10D_G12S_E22V_G24S_D123E_D141A_E143A_Y261A_L409S_Y410A_P411G | + |
| 52 | D141A_E143A_C223V_Y261A_L409S_Y410A_P411G_A485S_K507L_D671R | + |
| 53 | D141A_E143A_Y261A_L409S_Y410A_P411G_I709F_K725E | 0 |
| 54 | D141A_E143A_Y261A_L409A_Y410G | ++ |
| 55 | D141A_E143A_Y261A_L409S_Y410A_P411G_C509S_S557C_I596T | + |
| 56 | D6S_D141A_E143A_Y261A_L409S_Y410A_P411G | 0 |

FIG. 29C

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 57 | D141A_E143A_Y261A_V360A_E394G_L409S_Y410A_P411G_P421S_K443R_Q497H | + |
| 58 | D141A_E143A_Y261A_L357P_R359H_L409S_Y410A_P411G | ++ |
| 59 | D141A_E143A_Y261A_L409Y_Y410G_T514G | ++ |
| 60 | D141A_E143A_Y261A_L409S_Y410A_P411G_K693M_K708M | ++ |
| 61 | D141A_E143A_Y261A_L409F_Y410A_P411A | 0 |
| 62 | D141A_E143A_Y261A_L367P_L409S_Y410A_P411G | + |
| 63 | D141A_E143A_Y261A_L409S_Y410G_P411G | 0 |
| 64 | G12S_R32C_L42Q_D44N_E57G_I66N_R97C_D98V_D141A_E143A_Y261A_L409S_Y410A_P411G | + |
| 65 | I51F_K53E_T55I_E57K_L76Q_A95V_R97C_L126F_A139E_D141A_E143A_Y261A_L409S_Y410A_P411G | + |
| 66 | Y7F_D141A_E143A_Y261A_Y362I_L409F_Y410A_P411G | ++ |
| 67 | Y7F_D141A_E143A_Y261A_Y362I_L409A_Y410A_P411A | 0 |
| 68 | V15M_I28T_E43K_K62R_R97C_D141A_E143A_Y261A_L409S_Y410A_P411G | + |
| 69 | D141A_E143A_Y261A_L409S_Y410A_P411G_C509V | ++ |
| 70 | D141A_E143A_Y261A_L409A_Y410G_P411A_T514S | ++ |
| 71 | D141A_E143A_Y261A_L409A_Y410G_P411G_T514S | ++ |
| 72 | E81D_P90R_D123V_K124E_D141A_E143A_Y261A_L409S_Y410A_P411G | + |
| 73 | D141A_E143A_Y261A_V353Q_Y403H_L409S_Y410A_P411G_I413F | + |

FIG. 29D

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 74 | Y7F_E78S_A117V_D141A_E143A_Y261A_Y362I_L409S_Y410A_A434D_A485S_S492G_K507L_T523I | + |
| 75 | D141A_E143A_Y261A_L409F_Y410G_P411V | 0 |
| 76 | Y7F_D141A_E143A_Y261A_L409S_Y410A_P411G_A485S_C509V_I521T | ++ |
| 77 | D141A_E143A_Y261A_L409S_Y410A_P411G_G495S | 0 |
| 78 | D141A_E143A_Y261A_Y356C_L409S_Y410A_P411G | + |
| 79 | D141A_E143A_Y261A_L409Y_Y410A | ++ |
| 80 | Y7F_D141A_E143A_Y261A_L409F_Y410A_P411A | 0 |
| 81 | D98N_R107S_R119H_D141A_E143A_Y261A_L409S_Y410A_P411G | + |
| 82 | D141A_E143A_Y261A_L409A_Y410G_P411V | 0 |
| 83 | D141A_E143A_Y261A_L409A_Y410G_P411A | + |
| 84 | D141A_E143A_Y261A_L409S_Y410A_P411G_S506C_R518C_P552L | + |
| 85 | D141A_E143A_Y261A_L409A_Y410A | ++ |
| 86 | D141A_E143A_C223V_Y261A_L409S_Y410A_P411G | + |
| 87 | A117V_D141A_E143A_Y261A_L409S_Y410A_A485S_S492G_K507L_D671R | ++ |
| 88 | K27M_D92N_F140S_D141A_E143A_Y261A_L409S_Y410A_P411G | + |
| 89 | D141A_E143A_Y261A_L409Y_Y410A_P411A | + |
| 90 | D141A_E143A_Y261A_L409S_Y410A_P411G_A623T_V628L_A650E_A674T_K707I_F747L_Y749F | + |
| 91 | D141A_E143A_Y261A_L409S_Y410A_P411G_G633S_V645E | 0 |

FIG. 29E

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 92 | K21E_E29V_E43D_D141A_E143A_Y261A_L409S_Y410A_P411G | + |
| 93 | D141A_E143A_Y261A_L409S_Y410A_P411G_A638E_K658R_A680V | + |
| 94 | A117V_D141A_E143A_Y261A_L409S_Y410A_P411G_A434D_A485S | + |
| 95 | D141A_E143A_Y261A_P372S_L409S_Y410A_P411G_V415M_G447D_D455N | + |
| 96 | D141A_E143A_Y261A_G388S_L409S_Y410A_P411G | 0 |
| 97 | E35G_I66T_V86D_D98E_D141A_E143A_Y261A_L409S_Y410A_P411G | ++ |
| 98 | V93A_E130G_D141A_E143A_Y261A_L409S_Y410A_P411G | + |
| 99 | Y7F_A117V_D141A_E143A_Y261A_L409S_Y410A_V415K_A485S_Y494A_K507L_I521H | ++ |
| 100 | D141A_E143A_Y261A_L409A_Y410G_P411G | + |
| 101 | D141A_E143A_Y261A_L409A_Y410G_T514A | ++ |
| 102 | D141A_E143A_Y261A_L409F_Y410G_P411A | 0 |
| 103 | E46V_D141A_E143A_Y261A_L409S_Y410A_P411G | ++ |
| 104 | Y7F_D141A_E143A_Y261A_L409S_Y410A_P411A | 0 |
| 105 | D141A_E143A_Y261A_G388R_L409S_Y410A_P411G | 0 |
| 106 | D141A_E143A_Y261A_S345C_Y356N_L409S_Y410A_P411G | + |
| 107 | I28N_R97S_E108V_D141A_E143A_Y261A_L409S_Y410A_P411G | + |
| 108 | D141A_E143A_Y261A_L409S_Y410A_P411G_K670E_L685E_L715Q_E718V_R723H_Q761L | 0 |
| 109 | D141A_E143A_Y261A_Y362I_L409S_Y410A_P411G | 0 |

FIG. 29F

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 110 | L42P_I65F_V71I_K72V_R97C_I100T_P104T_K136E_D141A_E143A_Y261A_L409S_Y410A_P411G | ++ |
| 111 | D141A_E143A_Y261A_L409Y_Y410A_P411G | ++ |
| 112 | D141A_E143A_Y261A_L409S_Y410A_P411G_L649Q_I698K | ++ |
| 113 | D141A_E143A_Y261A_L409S_Y410A_P411G_A485S_K507L | + |
| 114 | H59L_V63D_V68M_H89A_Y112C_I122N_D141A_E143A_Y261A_L409S_Y410A_P411G | + |
| 115 | R58H_E69K_Q91L_S102G_D141A_E143A_Y261A_L409S_Y410A_P411G | ++ |
| 116 | I54T_D113G_D141A_E143A_Y261A_L409S_Y410A_P411G | + |
| 117 | D141A_E143A_Y261A_L409S_Y410A_P411G_R631C_A650V_Y652H_K658E_E718K | 0 |
| 118 | D141A_E143A_Y261A_G350S_L409S_Y410A_P411G | 0 |
| 119 | K23M_D31V_F34I_G60D_V68M_V86I_R97H_R107C_F110S_D141A_E143A_Y261A_L409S_Y410A_P411G | + |
| 120 | D141A_E143A_Y261A_L409S_Y410A_P411G_T621I_I665V | + |
| 121 | D141A_E143A_Y261A_L409S_Y410A_P411V | 0 |
| 122 | A117V_D141A_E143A_Y261A_L409S_Y410A_P411G_I521H | + |
| 123 | P115S_D141A_E143A_Y261A_L409S_Y410A_P411G | 0 |
| 124 | R17H_G60D_D123E_D141A_E143A_Y261A_L409S_Y410A_P411G | + |
| 125 | D141A_E143A_Y261A_Y362I_L409A_Y410A_P411A | 0 |
| 126 | D141A_E143A_Y261A_L409A_Y410A_P411I | 0 |
| 127 | D141A_E143A_Y261A_N365S_L409S_Y410A_P411G_V419I_I436F_L453Q | 0 |
| 128 | D141A_E143A_Y261A_L409S_Y410A_P411G_A674S | 0 |

FIG. 29G

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 129 | D141A_E143A_Y261A_Y410G_P411I | 0 |
| 130 | D141A_E143A_Y261A_L409S_Y410A_P411G_G606S | 0 |
| 131 | H59Y_E111G_M129K_D141A_E143A_Y261A_L409S_Y410A_P411G | + |
| 132 | D141A_E143A_Y261A_L409A_Y410G_P411I | 0 |
| 133 | Y7F_D141A_E143A_Y261A_Y362I_L409S_Y410A_P411G | 0 |
| 134 | I54N_A117T_D141A_E143A_Y261A_L409S_Y410A_P411G | ++ |
| 135 | D141A_E143A_C223V_Y261A_L409S_Y410A_V415K_A485S | ++ |
| 136 | D141A_E143A_Y261A_L409S_Y410A_P411G_R631H_S706C_Q757L | + |
| 137 | D141A_E143A_Y261A_L409S_Y410A_P411G_E663R | 0 |
| 138 | D141A_E143A_Y180F_Y261A_V308I_L409S_Y410A_P411G | + |
| 139 | Y7F_E78S_D141A_E143A_Y261A_L409S_Y410A_P411G_V415K_A485S | + |
| 140 | D141A_E143A_Y261A_Y362I_L409F_Y410A_P411G | 0 |
| 141 | F19S_F34S_T55I_I114T_D141A_E143A_Y261A_L409S_Y410A_P411G | ++ |
| 142 | D141A_E143A_E238R_Y261A_L409S_Y410A_P411G | 0 |
| 143 | D141A_E143A_E251S_Y261A_L409S_Y410A_P411G | 0 |
| 144 | D141A_E143A_Y261A_L409A_Y410G_P411A_T514A | ++ |
| 145 | Y7F_D141A_E143A_Y261A_L409A_Y410A_P411A | 0 |
| 146 | P90L_D141A_E143A_Y261A_L409S_Y410A_P411G | + |

FIG. 29H

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 147 | D141A_E143A_Y261A_L409S_Y410A_P411G_R631H_Q686R_K691R_S721N_Q757L | 0 |
| 148 | D141A_E143A_Y261A_L409Y_Y410G_P411A | 0 |
| 149 | G12D_F19I_E57K_G60S_R101C_D123G_D141A_E143A_Y261A_L409S_Y410A_P411G | + |
| 150 | D141A_E143A_Y261A_L409F_Y410G_P411G | 0 |
| 151 | I16N_F34S_K118M_K136R_D141A_E143A_Y261A_L409S_Y410A_P411G | + |
| 152 | D141A_E143A_E238S_Y261A_L409S_Y410A_P411G | 0 |
| 153 | I28N_R58C_P90L_D141A_E143A_Y261A_L409S_Y410A_P411G | + |
| 154 | D141A_E143A_Y261A_S348C_L409S_Y410A_P411G_D422V | + |
| 155 | P36L_E111V_K136E_D141A_E143A_Y261A_L409S_Y410A_P411G | + |
| 156 | Y7F_E78S_A117V_D141A_E143A_Y261A_Y362I_L409S_Y410A_A434D_A485S_S492G_K507L_I521H | ++ |
| 157 | D141A_E143A_Y261A_L409A_Y410G_T514S | ++ |
| 158 | P94S_R119C_L126P_E130T_D141A_E143A_Y261A_L409S_Y410A_P411G | + |
| 159 | Y7F_E78S_D141A_E143A_Y261A_Y362I_L409S_Y410A_A434D_A485S_Y494A_K507L_D671R | ++ |
| 160 | V68M_D141A_E143A_Y261A_L409S_Y410A_P411G | + |
| 161 | D141A_E143A_Y261A_L409Y_Y410G_T514S | ++ |
| 162 | G12S_E49G_V93M_D141A_E143A_Y261A_L409S_Y410A_P411G | + |
| 163 | P36L_R97C_I109N_D141A_E143A_Y261A_L409S_Y410A_P411G | + |
| 164 | D141A_E143A_Y261A_L409A_Y410A_P411V | 0 |

FIG. 29I

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 165 | P90L_A95V_P115L_E130D_D141A_E143A_Y261A_L409S_Y410A_P411G | + |
| 166 | F19Y_Y39F_K74E_V106A_K136E_D141A_E143A_Y261A_L409S_Y410A_P411G | + |
| 167 | E78S_D141A_E143A_Y261A_L409S_Y410A_V415K_A485S_K507L | + |
| 168 | D141A_E143A_Y261A_L409S_Y410A_P411I | 0 |
| 169 | D141A_E143A_Y261A_L409S_Y410A_V415K_A485S | + |
| 170 | E43K_K74R_L135Q_L138P_D141A_E143A_Y261A_L409S_Y410A_P411G | 0 |
| 171 | Y7F_E78S_A117V_D141A_E143A_Y261A_Y362I_L409S_Y410A_V415K_A485S_Y494N_K507L_I521T_E663K_D671R | + |
| 172 | I8S_D141A_E143A_Y261A_L409S_Y410A_P411G | 0 |
| 173 | D141A_E143A_Y261A_Y362I_L409F_Y410A_P411A | 0 |
| 174 | K74R_I80N_P90L_F116S_D141A_E143A_Y261A_L409S_Y410A_P411G | + |
| 175 | D141A_E143A_Y261A_V360D_L409S_Y410A_P411G | + |
| 176 | D141A_E143A_Y261A_W355R_G396S_L409S_Y410A_P411G_A434V_R440H_I474V | + |
| 177 | D141A_E143A_Y261A_L409S_Y410G_P411A | 0 |
| 178 | A117V_D141A_E143A_Y261A_L409S_Y410A_V415R_A485S | ++ |
| 179 | D141A_E143A_Y261A_L409A_Y410A_T514S | ++ |
| 180 | D141A_E143A_Y261A_L409F_Y410A_P411I | 0 |
| 181 | D141A_E143A_Y261A_Y389R_L409S_Y410A_P411G | 0 |
| 182 | D141A_E143A_Y261A_P328A_L352M_A402T_L409S_Y410A_P411G_E427G_C428Y_I436T | + |

FIG. 29J

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 183 | D141A_E143A_Y261A_L409S_Y410A_P411G_I709V_D720E_G765S | 0 |
| 184 | K27M_D45V_R58C_D141A_E143A_Y261A_L409S_Y410A_P411G | 0 |
| 185 | D141A_E143A_Y261A_L409S_Y410A_P411G_K619R_V628L_I641F_V656I_I665V_S706N | ++ |
| 186 | A117V_D141A_E143A_Y261A_L409S_Y410A_P411G_A485S_S492G | + |
| 187 | P94L_H103R_P115L_D141A_E143A_Y261A_L409S_Y410A_P411G | + |
| 188 | D141A_E143A_Y261A_L409A_Y410A_P411G_T514G | ++ |
| 189 | Y7F_A117V_D141A_E143A_Y261A_L409S_Y410A_A434D_A485S_Y494A_K507L_S512R_I521H_E663K | + |
| 190 | D141A_E143A_Y261A_M381R_L409S_Y410A_P411G | 0 |
| 191 | D141A_E143A_Y261A_Y410A_P411G | 0 |
| 192 | E78N_A117V_D141A_E143A_Y261A_Y362I_L409S_Y410A_A485S_K507L_D671R | + |
| 193 | D141A_E143A_Y261A_L409S_Y410A_P411G | ++ |
| 194 | E43V_R97C_P128L_D141A_E143A_Y261A_L409S_Y410A_P411G | ++ |
| 195 | D141A_E143A_Y261A_L409S_Y410A_P411G_C509Y_H565Y_K569E_I617V | + |
| 196 | Y7F_D141A_E143A_Y261A_Y362I_L409S_Y410A_P411A | 0 |
| 197 | D141A_E143A_Y261A_L409Y_Y410G_P411I | 0 |
| 198 | D141A_E143A_E251R_Y261A_L409S_Y410A_P411G | 0 |
| 199 | E78N_D141A_E143A_C223V_Y261A_L409S_Y410A_V415K_A485S | + |
| 200 | Y7F_D141A_E143A_Y261A_L409F_Y410A_P411G | 0 |

FIG. 29K

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 201 | D141A_E143A_Y261A_L409S_Y410A_P411G_E620K_V740I | 0 |
| 202 | Y7F_A117V_D141A_E143A_Y261A_Y362I_L409S_Y410A_A485S_Y494A_K507L_S512R_I521T_E663K | + |
| 203 | D141A_E143A_Y261A_L409S_Y410A_P411G_E627K_H662V_E668G | 0 |
| 204 | Y7F_D141A_E143A_Y261A_L409S_Y410A_P411G | 0 |
| 205 | Y7F_E78N_A117V_D141A_E143A_Y261A_Y362I_L409S_Y410A_A434D_A485S_Y494A_K507L_S512R_K592Q_E663K_D671R | + |
| 206 | F19Y_R119H_D141A_E143A_Y261A_L409S_Y410A_P411G | + |
| 207 | D141A_E143A_Y261A_L409A_Y410A_P411G | ++ |
| 208 | D141A_E143A_Y261A_L409A_Y410G_P411A_T514G | ++ |
| 209 | D141A_E143A_Y261A_Y385S_L409S_Y410A_P411G | 0 |
| 210 | E10V_D141A_E143A_Y261A_L409S_Y410A_P411G | + |
| 211 | K13E_H89Y_F116L_L121M_D141A_E143A_Y261A_L409S_Y410A_P411G | + |
| 212 | D141A_E143A_Y261A_L409S_Y410A_P411G_P677L_R684H | 0 |
| 213 | I80F_R101C_P115S_E130D_D141A_I142V_E143A_Y261A_L409S_Y410A_P411G | ++ |
| 214 | P36L_D50V_L85V_F87L_R97P_D141A_E143A_Y261A_L409S_Y410A_P411G | + |
| 215 | R67C_I80N_V93A_D141A_E143A_Y261A_L409S_Y410A_P411G | + |
| 216 | E35D_R58C_E78K_I80N_P90S_E130K_D141A_E143A_Y261A_L409S_Y410A_P411G | + |
| 217 | D141A_E143A_Y261A_L404Q_L409S_Y410A_P411G_F448I_I449N_K468R_D472V | + |

FIG. 29L

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 218 | A117V_D141A_E143A_Y261A_L409S_Y410A_V415R_A485S_C509V | ++ |
| 219 | F87I_D141A_E143A_Y261A_L409S_Y410A_P411G | ++ |
| 220 | D141A_E143A_Y261A_L409A_Y410G_P411G_T514G | + |
| 221 | D141A_E143A_Y261A_L409S_Y410A_P411G_G676S_A746V_R758H | + |
| 222 | Y7F_E78N_A117V_D141A_E143A_Y261A_Y362I_L409S_Y410A_A434D_A485S_S492G_K507L_I521H_E663K_D671R | + |
| 223 | D141A_E143A_Y261A_L409A_Y410A_T514A | ++ |
| 224 | Y7F_D141A_E143A_Y261A_Y362I_L409F_Y410A_P411A | 0 |
| 225 | D141A_E143A_Y261A_L409F_Y410A_T514A | ++ |
| 226 | D141A_E143A_Y261A_L409S_Y410A_P411G_I629F_A639T_Q735H_A746V_K750N | ++ |
| 227 | D141A_E143A_Y261A_L409S_Y410A_V415K_A485S_D671R | ++ |
| 228 | K62E_V93A_M129V_D141A_E143A_P239S_Y261A_L409S_Y410A_P411G | + |
| 229 | D141A_E143A_Y261A_L409S_Y410A_P411G_E647G | ++ |
| 230 | G24S_R58L_F110L_R119H_M129I_D141A_E143A_Y261A_L409S_Y410A_P411G | + |
| 231 | D141A_E143A_Y261A_L409F_Y410A_T514S | ++ |
| 232 | Y7F_E78N_A117V_D141A_E143A_Y261A_Y362I_L409S_Y410A_A485S_Y494A_K507L_I521H | ++ |
| 233 | Y7F_D141A_E143A_Y261A_Y362I_L409S_Y410A_P411G_A485S_S492G_C509V | + |
| 234 | D141A_E143A_Y261A_L409S_Y410A_P411G_V610D_L715P | + |
| 235 | T55S_G56S_R58C_R97H_D141A_E143A_Y261A_L409S_Y410A_P411G | + |

FIG. 29M

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 236 | E78S_M129L_D141A_E143A_Y261A_L409S_Y410A_V415K_A485S | ++ |
| 237 | A117V_D141A_E143A_Y261A_L409S_Y410A_A434D_A485S_I521H_D671R | ++ |
| 238 | Y37N_S47G_R97H_K118R_D141A_E143A_Y261A_L409S_Y410A_P411G | + |
| 239 | D141A_E143A_Y261A_L409S_Y410A_P411G_H519N_I521N_I547F_V588E | + |
| 240 | Y7F_E78S_A117V_D141A_E143A_Y261A_Y362I_L409S_Y410A_V415K_A434D_A485S_Y494A_K507L_I521T_E663K_D671R | + |
| 241 | A117V_D141A_E143A_Y261A_Y362I_L409S_Y410A_V415R_A485S | + |
| 242 | D141A_E143A_Y261A_L409S_Y410A_P411G_T621S_E668G_L703P_E718K_Q757L | ++ |
| 243 | D141A_E143A_Y261A_L409Y_Y410G_T514A | ++ |
| 244 | Q91A_D141A_E143A_Y261A_L409S_Y410A_P411G | 0 |
| 245 | D141A_E143A_Y261A_L409S_Y410A_P411G_E508Q_E511K_I547T_H601R | + |
| 246 | D141A_E143A_Y261A_L409S_Y410A_P411G_K673I_S721C_V736A | 0 |
| 247 | I16T_G60S_I65T_A99T_S102N_D141A_E143A_Y261A_L409S_Y410A_P411G | + |
| 248 | K72R_A95V_R107C_E111V_P115S_D141A_E143A_Y261A_L409S_Y410A_P411G | + |
| 249 | D141A_E143A_Y261A_L409F_Y410A_T514G | ++ |
| 250 | D141A_E143A_Y261A_L409S_Y410A_K507L | + |
| 251 | P90D_D141A_E143A_Y261A_L409S_Y410A_P411G | + |
| 252 | D141A_E143A_Y261A_Y385R_L409S_Y410A_P411G | 0 |
| 253 | I38N_A95V_I122F_D141A_E143A_Y261A_L409S_Y410A_P411G | + |
| 254 | P94Q_D141A_E143A_Y261A_L409S_Y410A_P411G | 0 |

FIG. 29N

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 255 | V71I_I122F_D141A_E143A_Y261A_L409S_Y410A_P411G | + |
| 256 | Y7F_E78S_A117V_D141A_E143A_Y261A_Y362I_L409S_Y410A_V415R_A485S_I521T_D671R | + |
| 257 | D141A_E143A_Y261A_L409Y_Y410A_T514G | ++ |
| 258 | Y7F_E78S_D141A_E143A_C223V_Y261A_L409S_Y410A_V415K_A485S_D671R | ++ |
| 259 | D141A_E143A_Y261A_L409Y_Y410G_P411G | 0 |
| 260 | Y7F_E78S_A117V_D141A_E143A_Y261A_Y362I_L409S_Y410A_A434D_A485S_I521T_E663K_D671R | + |
| 261 | A40V_R119S_K136R_D141A_E143A_Y261A_L409S_Y410A_P411G | + |
| 262 | F75C_D92V_P94L_Y120C_D141A_E143A_Y261A_L409S_Y410A_P411G | ++ |
| 263 | Y7F_D141A_E143A_Y261A_L409S_Y410A_V415K_A485S_D671R | 0 |
| 264 | D141A_E143A_Y261A_L409F_Y410A_P411V | 0 |
| 265 | D141A_E143A_Y261A_G338D_E376K_L409S_Y410A_P411G_I449F_S451N | + |
| 266 | D141A_E143A_Y261A_L409S_Y410A_P411G_E636G_D711G_F716L_D720V_P728L_Y730H_K752E_T762N | 0 |
| 267 | I28F_I122F_L135M_D141A_E143A_Y261A_L409S_Y410A_P411G | ++ |
| 268 | D141A_E143A_Y261A_L409S_Y410A_P411G_S634C_V645I_R653C_V736A | 0 |
| 269 | I16F_K23E_L41P_E49K_D141A_E143A_Y261A_L409S_Y410A_P411G | + |
| 270 | D44N_S47R_F87I_Y120N_D141A_E143A_Y261A_L409S_Y410A_P411G | + |
| 271 | D141A_E143A_Y261A_L409S_Y410A_P411G_E663S | 0 |

FIG. 29O

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 272 | D4N_A95V_R119H_F140Y_D141A_E143A_Y261A_L409S_Y410A_P411G | + |
| 273 | E46V_S47N_E57G_Q91H_I109K_D141A_E143A_Y261A_L409S_Y410A_P411G | + |
| 274 | I16T_V63I_D141A_E143A_Y261A_L409S_Y410A_P411G | 0 |
| 275 | D141A_E143A_Y261A_L409S_Y410A_P411G_S699I_Y756C | ++ |
| 276 | D141A_E143A_Y261A_L409A_Y410A_P411G_T514A | ++ |
| 277 | D141A_E143A_Y261A_Y389S_L409S_Y410A_P411G | 0 |
| 278 | D141A_E143A_Y261A_Y410A_P411A | 0 |
| 279 | P36L_E130G_D141A_E143A_Y261A_L409S_Y410A_P411G | ++ |
| 280 | D141A_E143A_Y261A_L409S_Y410A_P411G_D648V_E668K_A674V_V692I_V702A_Q735H | 0 |
| 281 | E57G_R97L_D113Y_E130K_D141A_E143A_Y261A_L409S_Y410A_P411G | + |
| 282 | R101C_D141A_E143A_Y261A_L409S_Y410A_P411G | + |
| 283 | D141A_E143A_Y261A_F406Y_L409S_Y410A_P411G_S412N_F448L_I474F | + |
| 284 | D141A_E143A_Y261A_L409A_Y410A_P411G_T514S | ++ |
| 285 | D141A_E143A_Y261A_L409S_Y410A_P411G_I629F_L630Q_V642I_K658I | 0 |
| 286 | D141A_E143A_Y261A_N351S_M381I_L409S_Y410A_P411G_P450L | ++ |
| 287 | F26L_I38T_V86I_R101C_D141A_E143A_Y261A_L409S_Y410A_P411G | ++ |
| 288 | D141A_E143A_Y261A_L409S_Y410A_P411A | + |

FIG. 29P

Table 1: Wild type RLF 89458.1 = SEQ ID NO:1; wild type RLF 78286 = SEQ ID NO:2

| SEQ# | Mutations based on SEQ ID NOS: 1 or 2 | Incorp'n |
|---|---|---|
| 289 | E29D_D50G_V71I_V93E_H103L_V106T_D141A_E143A_Y261A_L409S_Y410A_P411G | + |
| 290 | K20M_P36L_A40G_K62N_D141A_E143A_Y261A_L409S_Y410A_P411G | + |
| 291 | D6R_D141A_E143A_Y261A_L409S_Y410A_P411G | 0 |
| 292 | F34S_D45V_T55A_I122F_G132S_D141A_E143A_Y261A_L409S_Y410A_P411G | + |
| 293 | D141A_E143A_Y261A_L409S_Y410A_P411G_E508Q_E511K_I547T_H601R | + |

FIG. 29Q

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 294 | D141A_E143A_Y261A_T267W_I268W_L409S_Y410A_P411G | + |
| 295 | I114M_D141A_E143A_Y261A_L409S_Y410A_P411G | + |
| 296 | V93Y_D141A_E143A_Y261A_T267V_I268M_L409S_Y410A_P411G_D671R | ++ |
| 297 | D6S_Y7F_D141A_E143A_E251R_Y261A_Y362I_L409F_Y410A_P411A | + |
| 298 | D141A_E143A_Y261A_R269N_L409S_Y410A_P411G | + |
| 299 | D141A_E143A_D343E_Y261A_L409S_Y410A_P411G | ++ |
| 300 | V93Y_D141A_E143A_Y261A_I268V_L409S_Y410A_P411G_D671R | ++ |
| 301 | D141A_E143A_Y261A_L409S_Y410A_P411G_D648V_G689S | + |
| 302 | D141A_E143A_Y261A_L409S_Y410A_P411G_I635N_K708R_S722G | ++ |
| 303 | D141A_E143A_Y261A_L409S_Y410A_P411G_L741Q | ++ |
| 304 | D141A_E143A_Y261A_T274E_L409S_Y410A_P411G | ++ |
| 305 | V93Y_D141A_E143A_Y261A_I268M_L409S_Y410A_P411G_Y481F_D671R | + |
| 306 | D141A_E143A_Y261A_L409S_Y410A_P411G_A650T | ++ |
| 307 | D141A_E143A_Y261A_L409S_Y410A_P411G_E668K_D671R | ++ |
| 308 | D141A_E143A_Y261A_L409S_Y410A_P411G_E745V_K752E | ++ |
| 309 | Y7F_V93Y_D141A_E143A_Y261A_G350S_Y362I_L409F_Y410A_P411A_D671R_E755(del) | + |
| 310 | Y7F_D141A_E143A_E251R_Y261A_Y362I_L409F_Y410A_P411A_D671R | ++ |

FIG. 30A

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 311 | V93Y_D141A_E143A_Y261A_T267W_I268V_L409S_Y410A_P411G_D671R | ++ |
| 312 | D141A_E143A_Y261A_A298G_L409S_Y410A_P411G | + |
| 313 | V93Y_D141A_E143A_Y261A_L409S_Y410A_P411G_D541E_D671R | + |
| 314 | D141A_E143A_Y261A_L409S_Y410A_P411G_I665F_K707I_I709V_S721G_Q757^ | + |
| 315 | V93Y_D141A_E143A_Y261A_T267A_I268Y_L409S_Y410A_P411G_D671R | + |
| 316 | D141A_E143A_Y261A_L409S_Y410A_P411G_E636K_V654M_S706G_Q735R | ++ |
| 317 | V93Y_D141A_E143A_Y261A_Y362I_L409F_Y410A_P411A_E663S | + |
| 318 | D141A_E143A_Y261A_D315A_L409S_Y410A_P411G | + |
| 319 | V93Y_D141A_E143A_Y261A_L409S_Y410A_P411G_D539E_D671R | + |
| 320 | V93Y_D141A_E143A_Y261A_I268W_L409S_Y410A_P411G_Y481A_D671R | + |
| 321 | V93Y_D141A_E143A_Y261A_L409S_Y410A_P411G_D539A_D671R | + |
| 322 | D141A_E143A_Y261A_L409S_Y410A_P411G_K707N | + |
| 323 | V93Y_D141A_E143A_Y261A_I268F_L409S_Y410A_P411G_Y481V_D671R | ++ |
| 324 | D141A_E143A_Y261A_L409S_Y410A_P411G_E620K_D671R | + |
| 325 | V93Y_D141A_E143A_Y261A_I268M_L409S_Y410A_P411G_D671R | ++ |
| 326 | V93Y_D141A_E143A_Y261A_T267V_I268W_L409S_Y410A_P411G_D671R | ++ |
| 327 | D141A_E143A_Y261A_L409S_Y410A_P411G_R758^ | + |

FIG. 30B

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 328 | D141A_E143A_Y261A_L409S_Y410A_P411G_R612W | + |
| 329 | V93T_D141A_E143A_Y261A_L409S_Y410A_P411G_D671R | + |
| 330 | D141A_E143A_Y209W_Y261A_L409S_Y410A_P411G | + |
| 331 | Y7F_D141A_E143A_Y261A_A485L | ++ |
| 332 | D141A_E143A_G245S_Y261A_L409S_Y410A_P411G | + |
| 333 | V93Y_D141A_E143A_Y261A_I268W_L409S_Y410A_P411G_Y481V_D671R | ++ |
| 334 | D6S_Y7F_D141A_E143A_Y261A_L409S_Y410A_P411G | + |
| 335 | D4A_D141A_E143A_E251R_Y261A_D343A_L409S_Y410A_P411G | + |
| 336 | D141A_E143A_F214E_Y261A_L409S_Y410A_P411G | + |
| 337 | Y7F_V93F_D141A_E143A_E251R_Y261A_G350S_Y362I_L409F_Y410A_P411A_E663S_V679S | + |
| 338 | I114T_D141A_E143A_Y261A_L409S_Y410A_P411G | + |
| 339 | D141A_E143A_Y261A_T267M_I268V_L409S_Y410A_P411G | + |
| 340 | D141A_E143A_Y261A_T267W_I268Y_L409S_Y410A_P411G | + |
| 341 | D141A_E143A_Y261A_L409S_Y410A_P411G_Q686L | + |
| 342 | D141A_E143A_Y261A_N351S_L409S_Y410A_P411G | ++ |
| 343 | D141A_E143A_R247H_Y261A_P271S_L409S_Y410A_P411G | + |
| 344 | D141A_E143A_Y261A_T267F_I268Y_L409S_Y410A_P411G | + |

FIG. 30C

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 345 | D141A_E143A_Y261A_L409S_Y410A_P411G_R631H_R653Y_S722G_I732T_Q735H | + |
| 346 | D141A_E143A_Y261A_L409S_Y410A_P411G_K624I_G640D_T675S_Q735R | + |
| 347 | D141A_E143A_Y261A_L409S_Y410A_P411G_I690V | + |
| 348 | V93Y_D141A_E143A_Y261A_I268F_L409S_Y410A_P411G_Y481T_D671R | ++ |
| 349 | Q91P_V93A_D141A_E143A_Y261A_L409S_Y410A_P411G_D671R | + |
| 350 | D141A_E143A_Y261A_A485L | + |
| 351 | P36G_D141A_E143A_Y261A_L409S_Y410A_P411G | + |
| 352 | D141A_E143A_Y261A_T267W_L409S_Y410A_P411G | + |
| 353 | D141A_E143A_Y261A_L409S_Y410A_P411G_I681T_K683R_E718V_E751K | + |
| 354 | D141A_E143A_Y261A_W355F_L409S_Y410A_P411G | ++ |
| 355 | D141A_E143A_Y261A_L409S_Y410A_P411G_K670R_D671R | ++ |
| 356 | V93Y_D141A_E143A_Y261A_T267Y_L409S_Y410A_P411G_D671R | ++ |
| 357 | D141A_E143A_E251R_Y261A_Y362I_L409F_Y410A_P411A_E663S_V679S_L626 | + |
| 358 | D141A_E143A_Y261A_R269S_L409S_Y410A_P411G | + |
| 359 | V93Y_D141A_E143A_Y261A_T267Y_I268V_L409S_Y410A_P411G_D671R | ++ |
| 360 | D141A_E143A_Y261A_T267Y_L409S_Y410A_P411G | + |
| 361 | D141A_E143A_Y261A_T267A_I268A_L409S_Y410A_P411G | + |
| 362 | D141A_E143A_Y209E_Y261A_L409S_Y410A_P411G | + |

FIG. 30D

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 363 | V93Y_D141A_E143A_Y261A_T267A_I268A_L409S_Y410A_P411G_D671R | ++ |
| 364 | V93Y_D141A_E143A_Y261A_I268F_L409S_Y410A_P411G_Y481A_D671R | + |
| 365 | V93Y_D141A_E143A_Y261A_L409S_Y410A_P411G_D671R | ++ |
| 366 | D141A_E143A_Y261E_L409S_Y410A_P411G | + |
| 367 | D141A_E143A_Y261A_L409S_Y410A_P411G_T696S | ++ |
| 368 | D141A_E143A_Y261A_L409S_Y410A_P411G_R612E | + |
| 369 | V93Y_D141A_E143A_Y261A_I268V_L409S_Y410A_P411G_Y481A_D671R | ++ |
| 370 | D141A_E143A_Y261A_T267F_L409S_Y410A_P411G | + |
| 371 | D141A_E143A_F230L_T231I_Y261A_L409S_Y410A_P411G | + |
| 372 | D141A_E143A_Q196R_Y261A_L305P_L409S_Y410A_P411G | + |
| 373 | D141A_E143A_Y261A_T267W_I268M_L409S_Y410A_P411G | + |
| 374 | D141A_E143A_Y261A_L409S_Y410A_P411G_V642I | ++ |
| 375 | V93Y_D141A_E143A_Y261A_T267F_L409S_Y410A_P411G_D671R | ++ |
| 376 | D141A_E143A_Y261A_L409S_Y410A_P411G_Y652C_E668G_T675S_I690V | ++ |
| 377 | V93Y_D141A_E143A_Y261A_T267A_L409S_Y410A_P411G_D671R | ++ |
| 378 | D141A_E143A_Y261A_T272Y_L409S_Y410A_P411G_D671R | ++ |
| 379 | D141A_E143A_Y261A_L409S_Y410A_P411G_D671R_T675S | ++ |
| 380 | K118R_D141A_E143A_Y261A_L409S_Y410A_P411G | ++ |

FIG. 30E

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 381 | V93Y_D141A_E143A_Y261A_T267W_I268W_L409S_Y410A_P411G_D671R | + |
| 382 | D141A_E143A_Y261A_L409S_Y410A_P411G_D720Y | + |
| 383 | D141A_E143A_F214A_Y261A_L409S_Y410A_P411G | ++ |
| 384 | V93Y_D141A_E143A_Y261A_I268Y_L409S_Y410A_P411G_Y481A_D671R | + |
| 385 | D141A_E143A_Y261A_L409S_Y410A_P411G_Y672F | + |
| 386 | V93Y_D141A_E143A_Y261A_T267F_I268V_L409S_Y410A_P411G_D671R | ++ |
| 387 | D141A_E143A_Y261A_L409S_Y410A_P411G_L741Q | + |
| 388 | V93Y_D141A_E143A_Y261A_L409S_Y410A_P411G_D539G_D671R | + |
| 389 | D141A_E143A_Y261A_Q339N_L409S_Y410A_P411G | ++ |
| 390 | D141A_E143A_G211S_G245D_A249V_Y261A_L409S_Y410A_P411G | + |
| 391 | D141A_E143A_Y261A_L409S_Y410A_P411G_G633D | + |
| 392 | Y7F_D141A_E143A_E251R_Y261A_G350S_L409S_Y410A_P411G_D671R | + |
| 393 | V93Y_D141A_E143A_Y261A_I268Y_L409S_Y410A_P411G_D671R | ++ |
| 394 | D141A_E143A_N213Y_L228P_Y261A_M313K_L409S_Y410A_P411G | + |
| 395 | V93F_D141A_E143A_Y261A_L409S_Y410A_P411G_D671R | ++ |
| 396 | D141A_E143A_Y261A_T267V_I268W_L409S_Y410A_P411G | + |
| 397 | V93Y_D141A_E143A_Y261A_I268F_L409S_Y410A_P411G_D671R | ++ |
| 398 | D141A_E143A_Y261A_L275P_L409S_Y410A_P411G_D671R | ++ |

FIG. 30F

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 399 | D141A_E143A_Y261A_T267W_I268F_L409S_Y410A_P411G | + |
| 400 | D141A_E143A_Y261A_L275M_L409S_Y410A_P411G | ++ |
| 401 | P90M_D141A_E143A_Y261A_L409S_Y410A_P411G | + |
| 402 | D141A_E143A_Y261A_T267M_I268M_L409S_Y410A_P411G | ++ |
| 403 | D141A_E143A_Y261A_L409S_Y410A_P411G_N734R | + |
| 404 | D141A_E143A_Y261A_L409S_Y410A_P411G_E668K | ++ |
| 405 | D141A_E143A_Y146E_H147E_Y261A_L409S_Y410A_P411G | + |
| 406 | D141A_E143A_Y261A_L409S_Y410A_P411G_V642I_V679M_G689S_T696S | ++ |
| 407 | D141A_E143A_Y261A_L409S_Y410A_P411G_K670R | ++ |
| 408 | D141A_E143A_Y261A_L409S_Y410A_P411G_V610K | + |
| 409 | D141A_E143A_Y261A_I268F_L409S_Y410A_P411G | + |
| 410 | D6S_Y7F_D141A_E143A_Y261A_Y362I_L409F_Y410A_P411A_K429R_E663S | + |
| 411 | F116A_D141A_E143A_A261A_L409S_Y410A_P411G | + |
| 412 | D141A_E143A_Y261A | + |
| 413 | D141A_E143A_Y146E_F214A_Y261A_L409S_Y410A_P411G | ++ |
| 414 | V93Y_D141A_E143A_Y146E_Y261A_L409S_Y410A_P411G | ++ |
| 415 | D6S_Y7F_D141A_E143A_E251R_Y261A_L409F_Y410A_P411A_E663S | ++ |
| 416 | V93F_D141A_E143A_Y261A_Y362I_L409F_Y410A_P411A | ++ |

FIG. 30G

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 417 | D6S_R32(del)_P115S_D141A_E143A_E251R_Y261A_Y362I_L409F_Y410A_P411A_E663S_V679S | ++ |
| 418 | D141A_E143A_Y261A_T267A_I268Y_L409S_Y410A_P411G | + |
| 419 | D141A_E143A_R243E_Y261A_L409S_Y410A_P411G | + |
| 420 | D141A_E143A_Y261A_L409S_Y410A_P411G_R688S | ++ |
| 421 | D141A_E143A_Q242N_Y261A_L409S_Y410A_P411G | ++ |
| 422 | D141A_E143A_Y261A_L409S_Y410A_P411G_E575K_D671R | ++ |
| 423 | D141A_E143A_Y261A_L409S_Y410A_P411G_V645M_K704E | + |
| 424 | V93Y_D141A_E143A_Y261A_I268Y_L409S_Y410A_P411G_Y481W_D671R | + |
| 425 | D141A_E143A_Y261A_T267F_I268M_L409S_Y410A_P411G | + |
| 426 | P115(del)_D141A_E143A_A261A_L409S_Y410A_P411G | + |
| 427 | D141A_E143A_Y261A_L409S_Y410A_P411G_D671R_P677L | ++ |
| 428 | D141A_E143A_Y146E_Y261A_L409S_Y410A_P411G_D671R | ++ |
| 429 | V93Y_D141A_E143A_Y261A_L409S_Y410A_P411G_R612W_D671R | + |
| 430 | D141A_E143A_Y261A_K289Q_L409S_Y410A_P411G_D671R | ++ |
| 431 | D141A_E143A_V205A_Y261A_E276K_L409S_Y410A_P411G | + |
| 432 | D141A_E143A_Y261A_T267M_L409S_Y410A_P411G | + |
| 433 | D141A_E143A_Y261A_T267Y_I268Y_L409S_Y410A_P411G | + |

FIG. 30H

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 434 | D141A_E143A_Y261A_K289N_L409S_Y410A_P411G_D671R | ++ |
| 435 | D141A_E143A_Y261A_S347T_L409S_Y410A_P411G | ++ |
| 436 | D141A_E143A_Y261A_W355F_L409S_Y410A_P411G_D671R | ++ |
| 437 | D141A_E143A_H147E_Y261A_L409S_Y410A_P411G | ++ |
| 438 | D4A_D141A_E143A_E251A_Y261A_D343R_L409S_Y410A_P411G | + |
| 439 | P36M_D141A_E143A_Y261A_L409S_Y410A_P411G | + |
| 440 | D141A_E143A_Y261A_L409S_Y410A_P411G_K708R | + |
| 441 | D141A_E143A_Y261A_I268W_L409S_Y410A_P411G | + |
| 442 | V93Y_D141A_E143A_Y261A_I268M_L409S_Y410A_P411G_Y481A_D671R | ++ |
| 443 | D141A_E143A_Y261A_L409S_Y410A_P411G_G689S_Y756C | + |
| 444 | V93Y_D141A_E143A_Y261A_I268M_L409S_Y410A_P411G_Y481V_D671R | ++ |
| 445 | D141A_E143A_Y261A_L409S_Y410A_P411G_I732F | ++ |
| 446 | D141A_E143A_M244K_Y261A_V264I_M313L_L409S_Y410A_P411G | + |
| 447 | D141A_E143A_I219V_D246V_A261V_P262S_T267S_L409S_Y410A_P411G | ++ |
| 448 | V93Y_D141A_E143A_Y261A_I268W_L409S_Y410A_P411G_Y481W_D671R | + |
| 449 | D141A_E143A_Y261A_M329A_L409S_Y410A_P411G | + |
| 450 | V93Y_D141A_E143A_Y261A_I268A_L409S_Y410A_P411G_Y481A_D671R | + |

FIG. 30I

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 451 | Y7F_P115S_D141D_E143E_E251R_Y261A_Y362I_L409F_Y410A_P411A_E663S | + |
| 452 | D141A_E143A_Y261A_L409S_Y410A_P411G_V713I | ++ |
| 453 | V93(del)_D141A_E143A_Y261A_L409S_Y410A_P411G_D671R | + |
| 454 | V93Y_D141A_E143A_Y261A_R407K_L409S_Y410A_P411G_D671R | + |
| 455 | V93Y_D141A_E143A_Y261A_I268V_L409S_Y410A_P411G_Y481F_D671R | + |
| 456 | Y7F_D141A_E143A_L258I_Y261A_Y362I_L409F_Y410A_P411A_E663S | ++ |
| 457 | D141A_E143A_Y261A_L409S_Y410A_P411G_E647K_T666A | ++ |
| 458 | D141A_E143A_Y261A_L409S_Y410A_P411G_I629F_K725R_P738L_D753G | + |
| 459 | V93Y_D141A_E143A_Y261A_T267A_I268M_L409S_Y410A_P411G_D671R | ++ |
| 460 | D141A_E143A_Y261W_L409S_Y410A_P411G | + |
| 461 | D141A_E143A_R199H_T231I_Y261A_A298G_L409S_Y410A_P411G | ++ |
| 462 | D141A_E143A_Y261A_T267V_I268F_L409S_Y410A_P411G | + |
| 463 | V93Y_D141A_E143A_Y261A_T267A_I268V_L409S_Y410A_P411G_D671R | ++ |
| 464 | D141A_E143A_Y261A_K289E_L409S_Y410A_P411G | + |
| 465 | D6S_Y7F_58(del)_D141A_E143A_Y261A_L409F_Y410A_P411A_E663S_V679S | + |
| 466 | K118R_D141A_E143A_Y261A_L409S_Y410A_P411G_D671R | ++ |
| 467 | D141A_E143A_Y261A_Y320F_M329L_L409S_Y410A_P411G | ++ |
| 468 | D141A_E143A_Y261A_L409S_Y410A_P411G_D753G_L754S_E755G_Y756I_Q757S_R758A | + |

FIG. 30J

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 469 | D141A_E143A_Y146E_Y261A_T274E_L409S_Y410A_P411G | + |
| 470 | D141A_E143A_Y261A_T267A_I268M_L409S_Y410A_P411G | + |
| 471 | D141A_E143A_Y261A_L409S_Y410A_P411G_R611E | + |
| 472 | D141A_E143A_Y261A_L275P_L409S_Y410A_P411G | ++ |
| 473 | D141A_E143A_Y261A_D343A_L409S_Y410A_P411G | ++ |
| 474 | D141A_E143A_Y261A_L409S_Y410A_P411G_P677L | ++ |
| 475 | P115S_D141A_E143A_E251R_Y261A_G350S_Y362I_L409F_Y410A_P411A | + |
| 476 | Y7A_D141A_E143A_A261A_L409S_Y410A_P411G | + |
| 477 | D141A_E143A_Y261A_L409S_Y410A_P411G_I641V | + |
| 478 | D141A_E143A_E224V_L258Q_Y261A_K287R_E332K_L409S_Y410A_P411G | + |
| 479 | D141A_E143A_N213Y_Y261A_T274S_L409S_Y410A_P411G | ++ |
| 480 | Y7F_D141A_E143A_Y261A_Y362I_L409F_Y410A_P411A_E663S_L258 | ++ |
| 481 | D141A_E143A_Y261A_A292T_L409S_Y410A_P411G | + |
| 482 | D141A_E143A_Y261A_D343N_L409S_Y410A_P411G | ++ |
| 483 | D141A_E143A_Y261A_K289E_L409S_Y410A_P411G_D671R | ++ |
| 484 | V93K_D141A_E143A_Y261A_L409S_Y410A_P411G_D671R | + |
| 485 | D141A_E143A_Y261A_N351Q_L409S_Y410A_P411G | ++ |

FIG. 30K

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 486 | D141A_E143A_Y261A_L409S_Y410A_P411G_I635V_I709F | ++ |
| 487 | D141A_E143A_E251R_Y261A_Y362I_L409F_Y410A_P411A_D671R | + |
| 488 | Y7F_D141A_E143A_Y261A_E251R_L409F_Y410A_P411A | + |
| 489 | D141A_E143A_Y146A_Y261A_L409S_Y410A_P411G | + |
| 490 | D141A_E143A_Y261A_L409S_Y410A_P411G_Y499F_D671R | ++ |
| 491 | D141A_E143A_Y261A_T274W_L409S_Y410A_P411G | + |
| 492 | D141A_E143A_Y261A_I295N_L409S_Y410A_P411G | ++ |
| 493 | D141A_E143A_Y261A_A292N_L409S_Y410A_P411G | + |
| 494 | V93Y_D141A_E143A_Y261A_I268F_L409S_Y410A_P411G_Y481W_D671R | + |
| 495 | D141A_E143A_Y261A_L409S_Y410A_P411G_V610S | + |
| 496 | V93Y_D141A_E143A_Y261A_I268Y_L409S_Y410A_P411G_Y481V_D671R | ++ |
| 497 | Y37F_D141A_E143A_A261A_L409S_Y410A_P411G | + |
| 498 | D141A_E143A_Y261A_L409S_Y410A_P411G_V679M | + |
| 499 | D141A_E143A_Y261A_T272A_L409S_Y410A_P411G | + |
| 500 | D141A_E143A_R247E_Y261A_L409S_Y410A_P411G | + |
| 501 | D141A_E143A_Y261A_L409S_Y410A_P411G_P694R_R712C_Y726F_E755D | ++ |
| 502 | D141A_E143A_Y261A_L409S_Y410A_P411G_Y499F | ++ |

FIG. 30L

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 503 | V93Y_D141A_E143A_Y261A_I268M_L409S_Y410A_P411G_Y481T_D671R | ++ |
| 504 | D141A_E143A_Y261A_D315E_L409S_Y410A_P411G | + |
| 505 | V93Y_D141A_E143A_Y261A_I268Y_L409S_Y410A_P411G_Y481T_D671R | ++ |
| 506 | D141A_E143A_Y146E_Y261A_D315A_L409S_Y410A_P411G | + |
| 507 | D141A_E143A_Y261A_L409S_Y410A_P411G_T675I | ++ |
| 508 | D141A_E143A_Y261A_T272V_L409S_Y410A_P411G | + |
| 509 | D141A_E143A_F214W_Y261A_L409S_Y410A_P411G | + |
| 510 | D141A_E143A_Y261A_T272L_L409S_Y410A_P411G | + |
| 511 | D6S_Y7F_D141A_E143A_E251R_Y261A_L409S_Y410A_P411G | ++ |
| 512 | Q91K_V93A_D141A_E143A_Y261A_L409S_Y410A_P411G | ++ |
| 513 | D6S_Y7F_V93F_D141A_E143A_Y261A_L409S_Y410A_P411G_E663S | + |
| 514 | D4R_D141A_E143A_E251A_Y261A_D343A_L409S_Y410A_P411G | + |
| 515 | D141A_E143A_E251R_Y261A_G350S_L409S_Y410A_P411G_E663S_A538 | + |
| 516 | D141A_E143A_Y261A_L409S_Y410A_P411G_E616G_Y672F_I690F_H733R | ++ |
| 517 | V93Y_D141A_E143A_Y261A_L409S_Y410A_P411G_D541G_D671R | + |
| 518 | V93Y_D141A_E143A_Y261A_I268A_L409S_Y410A_P411G_Y481T_D671R | ++ |
| 519 | V93Y_D141A_E143A_Y261A_I268W_L409S_Y410A_P411G_Y481F_D671R | + |

FIG. 30M

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 520 | V93Y_D141A_E143A_G245R_Y261A_L409S_Y410A_P411G_D671R | ++ |
| 521 | D141A_E143A_Y261A_L409S_Y410A_P411G_A638V_E647K_P677L_I732N_R742L_I743E_L744A_E745F_A746G_F747Y_G748K_Y749E_E751D_K752L_D753E_L754Y_E755Q_Y756R_Q757M_R758K | ++ |
| 522 | V93Y_D141A_E143A_Y261A_R407N_L409S_Y410A_P411G_D671R | + |
| 523 | D141A_E143A_Y261A_L409S_Y410A_P411G_E663V_S722G | ++ |
| 524 | D141A_E143A_A190V_Y261A_L409S_Y410A_P411G | + |
| 525 | V93Y_D141A_E143A_Y261A_I268V_L409S_Y410A_P411G_Y481W_D671R | + |
| 526 | D141A_E143A_Y261A_D343R_L409S_Y410A_P411G | ++ |
| 527 | V93Y_D141A_E143A_Y261A_T267W_I268Y_L409S_Y410A_P411G_D671R | ++ |
| 528 | D141A_E143A_Y261A_P262R_L409S_Y410A_P411G_D671R | ++ |
| 529 | D141A_E143A_A190V_Y261A_K285I_M313I_E332K_L409S_Y410A_P411G | ++ |
| 530 | D141A_E143A_Y261A_L409S_Y410A_P411G_R653H | ++ |
| 531 | Q91H_V93F_D141A_Y261A_E143A_L409S_Y410A_P411G_D671R | + |
| 532 | Y7F_D141A_E143A_Y261A_Y362I_L409F_Y410A_P411A | ++ |
| 533 | D141A_E143A_Y261A_M329L_L409S_Y410A_P411G_D671R | ++ |
| 534 | D141A_E143A_Y261A_L409S_Y410A_P411G_A485L | + |
| 535 | D141A_E143A_Y261A_I268F_L409S_Y410A_P411G_D671R | ++ |
| 536 | I114V_D141A_E143A_Y261A_L409S_Y410A_P411G | + |

FIG. 30N

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 537 | D141A_E143A_Y261A_D315W_L409S_Y410A_P411G | + |
| 538 | D141A_E143A_Y261A_T267F_I268V_L409S_Y410A_P411G | + |
| 539 | D141A_E143A_Y261A_L409S_Y410A_P411G_A739V | + |
| 540 | D141A_E143A_Y209A_Y261A_L409S_Y410A_P411G | + |
| 541 | D141A_E143A_Y261A_L409S_Y410A_P411G_T666A | + |
| 542 | R119T_D141A_E143A_Y261A_L409S_Y410A_P411G | + |
| 543 | D141A_E143A_Y261A_L409S_Y410A_P411G_T675S | + |
| 544 | D141A_E143A_Y261A_L409S_Y410A_P411G_F586I_D671R | ++ |
| 545 | V93Y_D141A_E143A_Y261A_T267F_I268W_L409S_Y410A_P411G_D671R | ++ |
| 546 | P90K_D141A_E143A_Y261A_L409S_Y410A_P411G | + |
| 547 | D141A_E143A_A261A_R265D_L409S_Y410A_P411G | + |
| 548 | V93Y_D141A_E143A_Y261A_L409S_Y410A_P411G_D539A_D541A_D671R | + |
| 549 | D141A_E143A_E251R_Y261A_Y362I_L409F_Y410A_P411A_L626I_E663S_V679S_G748V | + |
| 550 | V93Y_D141A_E143A_Y261A_I268F_L409S_Y410A_P411G_Y481F_D671R | + |
| 551 | D141A_E143A_G245A_Y261A_L409S_Y410A_P411G | + |
| 552 | D141A_E143A_Y261A_L409S_Y410A_P411G_E657V_K707I | ++ |
| 553 | D141A_E143A_Y261A_T267A_I268W_L409S_Y410A_P411G | + |

FIG. 30O

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 554 | D141A_E143A_Y261A_L275M_L409S_Y410A_P411G_D671R | ++ |
| 555 | D141A_E143A_Y261A_T267A_L409S_Y410A_P411G | + |
| 556 | D6S_Y7F_V93F_D141A_E143A_E251R_Y261A_G350S_L409S_Y410A_P411G_E663S_A309 | + |
| 557 | D141A_E143A_K240E_Y261A_L409S_Y410A_P411G | ++ |
| 558 | D141A_E143A_Y261A_L409S_Y410A_P411G_R667E | + |
| 559 | V93Y_D141A_E143A_G245R_R247D_Y261A_L409S_Y410A_P411G_D671R | + |
| 560 | D141A_E143A_Y261A_I268M_L409S_Y410A_P411G | + |
| 561 | D141A_E143A_Y261A_L409S_Y410A_P411G_E616G_D671R | ++ |
| 562 | D141A_E143A_Y261A_L409S_Y410A_P411G_V713I | + |
| 563 | D141A_E143A_Y261A_T267F_I268F_L409S_Y410A_P411G | + |
| 564 | D141A_E143A_Y261A_Y273W_L409S_Y410A_P411G | + |
| 565 | D141A_E143A_Y261A_L409S_Y410A_P411G_T675A_S699G | ++ |
| 566 | D141A_E143A_Y146S_Y261A_L409S_Y410A_P411G | ++ |
| 567 | D141A_E143A_G233D_M244T_Y261A_L409S_Y410A_P411G | ++ |
| 568 | D141A_E143A_Y261A_T267A_I268V_L409S_Y410A_P411G | ++ |
| 569 | D4R_D141A_E143A_Y261A_L409S_Y410A_P411G | + |
| 570 | D141A_E143A_Y261A_L409S_Y410A_P411G_K673E | ++ |

FIG. 30P

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 571 | D141A_E143A_Y261A_V290E_L409S_Y410A_P411G | + |
| 572 | V93Y_D141A_E143A_Y261A_L409S_Y410A_P411G_D541A_D671R | + |
| 573 | D141A_E143A_Y261A_L409S_Y410A_P411G_L583P_D671R | ++ |
| 574 | D141A_E143A_P203S_F216L_G227S_A249G_Y261A_V308A_L409S_Y410A_P411G | ++ |
| 575 | D141A_E143A_Y261A_L409S_Y410A_P411G_T675A | + |
| 576 | V93Y_D141A_E143A_Y261A_T267V_L409S_Y410A_P411G_D671R | ++ |
| 577 | V93Y_D141A_E143A_Y261A_T267W_I268M_L409S_Y410A_P411G_D671R | ++ |
| 578 | D141A_E143A_Y261A_L409S_Y410A_P411G_R758H | ++ |
| 579 | D6S_V93F_D141A_E143A_E251R_Y261A_G350S_L409S_Y410A_P411G | + |
| 580 | D141A_E143A_F214V_Y261A_L409S_Y410A_P411G_D671R | ++ |
| 581 | D141A_E143A_Y261A_L409S_Y410A_P411G_I690V_P728S | ++ |
| 582 | Y7F_D141A_E143A_E251R_Y261A_Y362I_L409F_Y410A_P411A_V679S_C-termf | + |
| 583 | V93Y_D141A_E143A_Y261A_T267V_I268V_L409S_Y410A_P411G_D671R | ++ |
| 584 | I114K_D141A_E143A_Y261A_L409S_Y410A_P411G | + |
| 585 | D141A_E143A_Y261A_T267F_I268W_L409S_Y410A_P411G | + |
| 586 | D141A_E143A_Y261A_T267Y_I268F_L409S_Y410A_P411G | + |
| 587 | D141A_E143A_Y146E_Y261A_L409S_Y410A_P411G | ++ |

FIG. 30Q

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 588 | V93Y_D141A_E143A_Y261A_T267M_I268F_L409S_Y410A_P411G_D671R | ++ |
| 589 | D141A_E143A_Y261A_Y320F_L409S_Y410A_P411G | ++ |
| 590 | V93Y_D141A_E143A_Y261A_T267M_L409S_Y410A_P411G_D671R | ++ |
| 591 | V93Y_D141A_E143A_Y261A_I268A_L409S_Y410A_P411G_Y481V_D671R | ++ |
| 592 | D141A_E143A_E251R_Y261A_Y362I_L409F_Y410A_P411A_E663S | + |
| 593 | D141A_E143A_Y261A_L409S_Y410A_P411G_D671R | ++ |
| 594 | R119V_D141A_E143A_Y261A_L409S_Y410A_P411G | + |
| 595 | V93Y_D141A_E143A_Y261A_T267V_I268F_L409S_Y410A_P411G_D671R | ++ |
| 596 | D141A_E143A_Y261A_Y311W_L409S_Y410A_P411G | + |
| 597 | D141A_E143A_Y261A_L409S_Y410A_P411G_L630Q_A680V_E745V | + |
| 598 | Y7F_P14Q_P115S_D141A_E143A_E251R_Y261A_L409S_Y410A_P411G_E663S | ++ |
| 599 | D141A_E143A_E251A_Y261A_L409S_Y410A_P411G | + |
| 600 | D141A_E143A_Y261A_L409S_Y410A_P411G_E663S_V679S | + |
| 601 | D6S_Y7F_D141A_E143A_Y261A_L409S_Y410A_P411G_E663S_V679S | + |
| 602 | V93G_D141A_E143A_Y261A_L409S_Y410A_P411G_D671R | + |
| 603 | D6S_Y7F_D141A_E143A_E251R_Y261A_G350S_Y362I_L409F_Y410A_P411A_E663S_V679S | + |
| 604 | D141A_E143A_Y261A_L409S_Y410A_P411G_G689S | + |

FIG. 30R

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 605 | Y7F_D141A_E143A_E251R_Y261A_L409F_Y410A_P411A | + |
| 606 | D141A_E143A_Y261A_L409S_Y410A_P411G_E620V_P728S_I743V | ++ |
| 607 | V93Y_D141A_E143A_Y261A_I268A_L409S_Y410A_P411G_Y481F_D671R | + |
| 608 | D141A_E143A_Y261A_Y273A_L409S_Y410A_P411G | + |
| 609 | V93Y_D141A_E143A_R247D_Y261A_L409S_Y410A_P411G_D671R | + |
| 610 | V93Y_D141A_E143A_Y261A_I268Y_L409S_Y410A_P411G_Y481F_D671R | + |
| 611 | D141A_E143A_R247S_Y261A_L409S_Y410A_P411G | + |
| 612 | D141A_E143A_Y261A_L409S_Y410A_P411G_V610A | + |
| 613 | D141A_E143A_Y261A_L409S_Y410A_P411G_R612F | + |
| 614 | D141A_E143A_Y261A_T267V_I268M_L409S_Y410A_P411G | + |
| 615 | D141A_E143A_Y261A_L409S_Y410A_P411G_Q664A | + |
| 616 | D141A_E143A_Y261A_L409S_Y410A_P411G_K670I_G705D | + |
| 617 | V93Y_D141A_E143A_Y261A_I268A_L409S_Y410A_P411G_D671R | ++ |
| 618 | D141A_E143A_Y261A_L409S_Y410A_P411G_V702I_Y749F_E755K | ++ |
| 619 | D4A_D141A_E143A_Y261A_L409S_Y410A_P411G | + |
| 620 | D141A_E143A_Y261A_E332K_L409S_Y410A_P411G | + |
| 621 | V93Y_D141A_E143A_Y261A_T267M_I268M_L409S_Y410A_P411G_D671R | ++ |

FIG. 30S

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 622 | D141A_E143A_Y261A_A292I_L409S_Y410A_P411G | + |
| 623 | D141A_E143A_Y261A_L409S_Y410A_P411G_Q664L | + |
| 624 | D141A_E143A_Y261A_P262R_L409S_Y410A_P411G | ++ |
| 625 | D141A_E143A_Y261A_L409S_Y410A_P411G_T604S_D671R | ++ |
| 626 | D141A_E143A_Y261A_P262S_T267I_R269H_R307C_L409S_Y410A_P411G | + |
| 627 | D141A_E143A_Y261A_L409S_Y410A_P411G_Q622L_A682T | + |
| 628 | D141A_E143A_D246E_Y261A_V264A_S301N_L409S_Y410A_P411G | ++ |
| 629 | V93S_D141A_E143A_Y261A_L409S_Y410A_P411G_D671R | + |
| 630 | D141A_E143A_G245R_Y261A_L409S_Y410A_P411G_D671R | ++ |
| 631 | D141A_E143A_Y261A_L409S_Y410A_P411G_V610T | ++ |
| 632 | D141A_E143A_Y261A_L409S_Y410A_P411G_E620D_A638T_N651S_K704I_R742C | ++ |
| 633 | D141A_E143A_Y261A_I268A_L409S_Y410A_P411G | + |
| 634 | D141A_E143A_Y261A_L409S_Y410A_P411G_A687T_K707N | ++ |
| 635 | D141A_E143A_Y261A_T272Y_L409S_Y410A_P411G_R612W_D671R | ++ |
| 636 | D141A_E143A_Y261A_L409S_Y410A_P411G_E668G_D671R | ++ |
| 637 | D141A_E143A_E251R_Y261A_G350S_L409S_Y410A_P411G_E663S_V679S_L563 | ++ |
| 638 | D141A_E143A_Y261A_T267M_I268F_L409S_Y410A_P411G | + |

FIG. 30T

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 639 | D141A_E143A_Y261A_A292N_L409S_Y410A_P411G_D671R | ++ |
| 640 | D141A_E143A_Y261A_M329L_L409S_Y410A_P411G | + |
| 641 | D141A_E143A_Y261A_L409S_Y410A_P411G_E663V_S706C | + |
| 642 | V93Y_D141A_E143A_Y261A_L409S_Y410A_P411G_E577D_D671R | + |
| 643 | V93Y_D141A_E143A_Y261A_T267M_I268V_L409S_Y410A_P411G_D671R | ++ |
| 644 | D141A_E143A_Y261A_R269K_L409S_Y410A_P411G | + |
| 645 | V93Y_D141A_E143A_Y261A_I268W_L409S_Y410A_P411G_D671R | ++ |
| 646 | D141A_E143A_Y261A_R269V_L409S_Y410A_P411G | + |
| 647 | D141A_E143A_F214A_Y261A_L409S_Y410A_P411G_D671R | ++ |
| 648 | Q91N_D141A_E143A_A261A_L409S_Y410A_P411G | + |
| 649 | D141A_E143A_Y261A_L409S_Y410A_P411G_A687S_K725L | ++ |
| 650 | D141A_E143A_Y261A_T267V_L409S_Y410A_P411G | + |
| 651 | Y7F_P14(del)_P115S_D141A_E143A_E251R_Y261A_L409S_Y410A_P411G_E663S | ++ |
| 652 | D141A_E143A_Y218H_Y261A_K286E_E297G_L409S_Y410A_P411G | + |
| 653 | D141A_E143A_Y261A_I268A_L409S_Y410A_P411G_D671R | ++ |
| 654 | V93Y_D141A_E143A_Y261A_I268V_L409S_Y410A_P411G_Y481V_D671R | ++ |
| 655 | D141A_E143A_M244T_Y261A_L409S_Y410A_P411G | ++ |

FIG. 30U

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 656 | D141A_E143A_Y261A_R269T_L409S_Y410A_P411G | + |
| 657 | D141A_E143A_Y261A_L409S_Y410A_P411G_R742K | + |
| 658 | D141A_E143A_Y261A_L409S_Y410A_P411G_E745V | + |
| 659 | V93Y_D141A_E143A_E251R_Y261A_G350S_L409S_Y410A_P411G_E663S | ++ |
| 660 | D141A_E143A_Y261A_D315R_L409S_Y410A_P411G | + |
| 661 | V93Y_D141A_E143A_Y261A_T267A_I268W_L409S_Y410A_P411G_D671R | ++ |
| 662 | D141A_E143A_Y261A_T267A_I268F_L409S_Y410A_P411G | + |
| 663 | D141A_E143A_Y261A_L409S_Y410A_P411G_E668K_T675S_Q686L_G689S_A739V | ++ |
| 664 | D141A_E143A_Y261A_T267W_I268V_L409S_Y410A_P411G | + |
| 665 | V93Y_D141A_E143A_F214V_Y261A_L409S_Y410A_P411G_D671R | + |
| 666 | D141A_E143A_Y261A_L409S_Y410A_P411G_I617V_E620^ | + |
| 667 | D141A_E143A_Y261A_T267Y_I268M_L409S_Y410A_P411G | + |
| 668 | D141A_E143A_Y261A_L409S_Y410A_P411G_L630M | ++ |
| 669 | V93Y_D141A_E143A_Y261A_Y362I_L409F_Y410A_P411A_V625 | ++ |
| 670 | Y7F_D141A_E143A_E251R_Y261A_Y362I_L409F_Y410A_P411A | + |
| 671 | D141A_E143A_Y261A_Y311A_L409S_Y410A_P411G | ++ |
| 672 | D141A_E143A_Y261A_Y311E_L409S_Y410A_P411G | + |

FIG. 30V

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 673 | D141A_E143A_Y261A_T267Y_I268W_L409S_Y410A_P411G | + |
| 674 | D141A_E143A_Y261A_L409S_Y410A_P411G_R612W_D671R | ++ |
| 675 | D141A_E143A_Y261A_L409S_Y410A_P411G_K704N | + |
| 676 | V93Y_D141A_E143A_Y261A_T272Y_L409S_Y410A_P411G_D671R | ++ |
| 677 | D141A_E143A_Y261A_T272S_L409S_Y410A_P411G | + |
| 678 | D141A_E143A_I232F_Y261A_A277V_R317C_L409S_Y410A_P411G | + |
| 679 | D141A_E143A_Y261A_L409S_Y410A_P411G_H678Q | + |
| 680 | D141A_E143A_Y261A_L409S_Y410A_P411G_P728S | + |
| 681 | D141A_E143A_Y261A_L409S_Y410A_P411G_K752E | + |
| 682 | D141A_E143A_M244T_Y261A_L409S_Y410A_P411G_D671R | + |
| 683 | D141A_E143A_Y261A_L409S_Y410A_P411G_D671R_T696S | + |
| 684 | D141A_E143A_Y261A_L409S_Y410A_P411G_K507S_D671R | + |
| 685 | D141A_E143A_Y261A_Y320F_L409S_Y410A_P411G_D671R | + |
| 686 | D141A_E143A_Y261A_L409S_Y410A_P411G_E668R | + |
| 687 | D141A_E143A_Y261A | + |
| 688 | V93Y_D141A_E143A_Y261A_L409S_Y410A_P411G_D671R_R758^ | + |
| 689 | D141A_E143A_Y261A_L409S_Y410A_P411G_D671R_A739V | + |

FIG. 30W

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 690 | D141A_E143A_Y261A_L409S_Y410A_P411G_E529N_D671R | + |
| 691 | D141A_E143A_Y261A_L409S_Y410A_P411G_S699G | + |
| 692 | V93Y_D141A_E143A_Y261A_A292N_L409S_Y410A_P411G_D671R | + |
| 693 | D141A_E143A_Y261A_L409S_Y410A_P411G_D671R_L741Q | + |
| 694 | D141A_E143A_Y261A_L409S_Y410A_P411G_D671R_G689S | + |
| 695 | D141A_E143A_Y261A_L409S_Y410A_P411G_E616G_E668K | ++ |
| 696 | D141A_E143A_Y261A_L409S_Y410A_P411G_D671R_K708R | + |
| 697 | D141A_E143A_Y261A_L409S_Y410A_P411G_R758^ | + |
| 698 | V93Y_D141A_E143A_Y261A_P262R_L409S_Y410A_P411G_D671R | + |
| 699 | V93F_D141A_E143A_Y261A_M329L_L409S_Y410A_P411G_D671R | ++ |
| 700 | D141A_E143A_Y261A_L409S_Y410A_P411G_D671R_V679M | + |
| 701 | D141A_E143A_Y261A_A292N_L409S_Y410A_P411G_E668K | ++ |
| 702 | D141A_E143A_Y261A_L409S_Y410A_P411G_D671R_E745V | + |
| 703 | D141A_E143A_K240E_Y261A_L409S_Y410A_P411G_D671R | + |
| 704 | V93Y_D141A_E143A_Y261A_M329L_L409S_Y410A_P411G_D671R | ++ |
| 705 | V93Y_D141A_E143A_Y261A_L409S_Y410A_P411G_E668K | ++ |
| 706 | D141A_E143A_Y261A_E288K_L409S_Y410A_P411G_D671R | + |

FIG. 30X

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 707 | V93F_D141A_E143A_Y261A_L409S_Y410A_P411G_E668G_D671R | ++ |
| 708 | V93F_D141A_E143A_Y261A_L409S_Y410A_P411G_E668K_D671R | + |
| 709 | D141A_E143A_Y261A_L409S_Y410A_P411G_R465T | + |
| 710 | V93F_D141A_E143A_Y261A_A292N_L409S_Y410A_P411G_D671R | + |
| 711 | D141A_E143A_Y261A_L409S_Y410A_P411G_D671R_R688S | + |
| 712 | D141A_E143A_Y261A_L409S_Y410A_P411G_Y652M | + |
| 713 | D141A_E143A_Y261A_L409S_Y410A_P411G_D671R_R758^ | + |
| 714 | D141A_E143A_Y261A_E288K_L409S_Y410A_P411G | + |
| 715 | V93Y_D141A_E143A_Y261A_L409S_Y410A_P411G_E668G_D671R | ++ |
| 716 | V93F_D141A_E143A_Y261A_L409S_Y410A_P411G_E668K | ++ |
| 717 | D141A_E143A_Y261A_L409S_Y410A_P411G_K507S | + |
| 718 | D141A_E143A_Y261A_L409S_Y410A_P411G_R465T_D671R | + |
| 719 | D141A_E143A_Y261A_L409S_Y410A_P411G_E668K_R758^ | + |
| 720 | V93Y_D141A_E143A_Y261A_L409S_Y410A_P411G_E668K_D671R | ++ |
| 721 | D141A_E143A_Y261A_L409S_Y410A_P411G_D671R_K752E | + |

FIG. 30Y

Table 2: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 722 | D141A_E143A_Y261A_L409S_Y410A_P411G_D671R_Q686L | + |
| 723 | D141A_E143A_Y261A_L409S_Y410A_P411G_D671R_I690V | + |
| 724 | D141A_E143A_Y261A_L409S_Y410A_P411G_Q664L_D671R | ++ |
| 725 | D141A_E143A_Y261A_L409S_Y410A_P411G_Y652L | + |

FIG. 30Z

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 726 | D141A_E143A_Y261A_L409S_Y410A_P411G_K487M | |
| 727 | P94W_D141A_E143A_Y261A_L409S_Y410A_P411G | |
| 728 | D141A_E143Y_Y261A_L409S_Y410A_P411G | ++ |
| 729 | D141A_E143A_Y261A_L409S_Y410A_P411G_R612M | |
| 730 | Y7F_D141A_E143A_Y261A_L409F_Y410N_P411A_V642A | |
| 731 | Y7F_D141A_E143A_Y261A_L409I_Y410M | |
| 732 | V93Y_D141A_E143A_Y261A_L409S_Y410A_P411G_E616G_D671R | ++ |
| 733 | N11S_D141A_E143A_Y261A_L409S_Y410A_P411G_A485S | |
| 734 | D141A_E143A_L409S_Y410A_P411G | |
| 735 | V93Y_D141A_E143A_Y261A_L409S_Y410A_P411G_R612G_D671R | |
| 736 | D6S_Y7F_D141A_E143A_E251R_Y261A_L409S_Y410A_P411G_E663S_V679S | |
| 737 | D141A_E143A_Y261A_L409S_Y410G_Y493I | |
| 738 | D141A_E143A_Y261A_L409S_Y410A_P411G_V415K | |
| 739 | P90G_D141A_E143A_Y261A_L409S_Y410A_P411G | |
| 740 | Y7F_D141A_E143A_Y261A_L409F_Y410M_P411L | |
| 741 | Y7F_D141A_E143A_Y261A_L409F_Y410D_P411L | |
| 742 | D141A_E143A_Y261A_L409S_Y410A_P411G_E616^ | |
| 743 | D141A_E143A_Y410A_Y493I | |
| 744 | D141A_E143A_C223V_Y261A_L409S_Y410A_P411G_C509V | |

FIG. 31A

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 745 | D141A_E143A_Y261A_L409F_Y410A_P411G_A485S_Y493I | |
| 746 | Y7F_D141A_E143A_Y261A_A485T | |
| 747 | Y7F_D141A_E143A_Y261A_L409F_Y410M_P411A | |
| 748 | Y7F_D141A_E143A_Y261A_L409F_Y410D | |
| 749 | D141A_E143A_Y261A_L333V_L409S_Y410A_P411G | + |
| 750 | D141A_E143A_Y261A_Y410G_P411G | |
| 751 | D141A_E143A_Y261A_L409S_Y410A_P411G_R465^ | |
| 752 | D141N_E143A_Y261A_L409S_Y410A_P411G | ++ |
| 753 | D141A_E143A_Y261A_L409S_Y410A_P411G_A650V | |
| 754 | P90A_D141A_E143A_Y261A_L409S_Y410A_P411G | |
| 755 | D6S_Y7F_V93Y_D141A_E143A_E251R_Y261A_Y385R_L409S_Y410A_P411G_E663S | |
| 756 | Y7F_D141A_E143A_Y261A_L409N_Y410A | |
| 757 | Y7F_D141A_E143A_Y261A_L409F_Y410F_V642A | |
| 758 | I54K_L138P_D141A_E143A_Y261A_L409S_Y410A_P411G_A485S | |
| 759 | D141A_E143A_Y261A_I268V_L409S_Y410A_P411G | |
| 760 | Y7F_D141A_E143A_Y261A_L409L_Y410T | |
| 761 | D141A_E143A_Y261A_L409S_Y410A_P411G_D613S | ++ |
| 762 | D141A_E143A_Y261A_L409S_Y410A_P411G_D671K | + |
| 763 | D141A_E143A_L409S_Y493I | |

FIG. 31B

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 764 | Y7F_D141A_E143A_Y261A_L409F_Y410T_P411L_V642A | |
| 765 | V93Y_D141A_E143A_Y261A_T272F_L409S_Y410A_P411G_D671R | |
| 766 | D141A_E143A_Y261A_L409S_Y410A_P411G_V415T | |
| 767 | V93Y_D141A_E143A_Y261A_L409S_Y410A_P411G_R612F_D671R | |
| 768 | Y7F_D141A_E143A_Y261A_L409V_Y410F | |
| 769 | V93Y_D141A_E143A_N213W_Y261A_L409S_Y410A_P411G_D671R | + |
| 770 | V93Y_D141A_E143A_Y261A_L409S_Y410A_P411G_Y481T_D671R | |
| 771 | D141A_E143L_Y261A_L409S_Y410A_P411G | ++ |
| 772 | Y7F_D141A_E143A_Y261A_L409V_Y410D | |
| 773 | D141A_E143A_Y410A | |
| 774 | V93F_D141A_E143A_Y261A_L409S_Y410A_P411G | |
| 775 | E10K_R17H_D141A_E143A_Y146C_Y261A_L409S_Y410A_P411G_A485S | |
| 776 | Y7F_D141A_E143A_Y261A | ++ |
| 777 | P36A_D141A_E143A_Y261A_L409S_Y410A_P411G | |
| 778 | K23M_V68M_K84R_D141A_E143A_Y261A_L409S_Y410A_P411G_A485S | |
| 779 | D141A_E143A_Y261A_L409S_Y410A_P411G_E668P | + |
| 780 | Y7F_K72H_R119H_D141A_E143A_Y362I_Y410A | |
| 781 | Y37F_D141A_E143A_Y261A_L409S_Y410A_P411G | |
| 782 | Y7F_D141A_E143A_Y261A_L409F_Y410L_V642A | |

FIG. 31C

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 783 | N33S_A40V_G56V_L76Q_H103Y_I122F_D141A_E143A_Y261A_L409S_Y410A_P411G_A485S | |
| 784 | Y37N_F87I_D141A_E143A_Y261A_L409S_Y410A_P411G_A485S | |
| 785 | D6S_Y7F_P115_D141A_E143A_E251R_Y261A_Y385R_L409S_Y410A_P411G_E663S | |
| 786 | V93Y_D141A_E143A_Y261A_T272H_L409S_Y410A_P411G_D671R | |
| 787 | V93Y_D141A_E143A_Y261A_L409S_Y410A_P411G_R612H_E616G_D671R | + |
| 788 | V93Y_D141A_E143A_Y261A_T272L_L409S_Y410A_P411G_D671R | |
| 789 | Y7F_I122V_D141A_E143A_Y261A_Y362I_L409A_Y410A_P411A_A485S | |
| 790 | I114G_D141A_E143A_Y261A_L409S_Y410A_P411G | |
| 791 | D141A_E143A_Y261A_L409S_Y410A_P411G | |
| 792 | D141Y_E143A_Y261A_L409S_Y410A_P411G | ++ |
| 793 | H103Q_D141A_E143A_Y261A_L409S_Y410A_P411G_A485S | |
| 794 | Q91L_V93F_D141A_E143A_Y261A_L409S_Y410A_P411G | |
| 795 | D141A_E143A_Y261A_L409S_Y410G_P411V | |
| 796 | D141A_E143A_Y261A_L409S_Y410A_P411G_T514A | |
| 797 | V93Y_D141A_E143A_Y261A_L409S_Y410A_P411G_Y481V_D671R | |
| 798 | Y7F_D141A_E143A_Y261A_L409L_Y410L | |
| 799 | F140L_D141A_E143A_R234C_G245D_Y261A_V264I_E288G_E332G_L409S_Y410A_P411G | |
| 800 | P36T_D141A_E143A_Y261A_L409S_Y410A_P411G | |
| 801 | D141A_E143V_Y261A_L409S_Y410A_P411G | ++ |

FIG. 31D

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 802 | V93Y_D141A_E143A_Y261A_L409S_Y410A_P411G_R612I_D671R | |
| 803 | D141A_E143A_Y261A_R265D_L409S_Y410A_P411G | |
| 804 | D141A_E143A_Y261A_T267M_I268Y_L409S_Y410A_P411G | |
| 805 | V93Y_D141A_E143A_Y261A_L409S_Y410A_P411G_R612H_D671R | + |
| 806 | D141A_E143A_Y261A_Y410G | |
| 807 | V93Y_D141A_E143A_Y261A_T272K_L409S_Y410A_P411G_D671R | |
| 808 | D141A_E143A_Y261A_L409S_Y410A_P411G_T762^ | |
| 809 | D141A_E143A_Y261A_L409F_Y410A_P411G_A485S | |
| 810 | D141A_E143A_Y261A_R269L_L409S_Y410A_P411G | |
| 811 | D141A_E143A_C223V_Y261A_L409S_Y410A_P411G_C509V_D648C | |
| 812 | V93Y_D141A_E143A_Y261A_L409S_Y410A_P411G_A485T_D671R | |
| 813 | V93Y_D141A_E143A_N213E_Y261A_L409S_Y410A_P411G_D671R | + |
| 814 | Y7F_D141A_E143A_Y362I_Y410A_S492G_Y493I | |
| 815 | D141A_E143A_Y261A_L409S_Y410A_P411G_K464^ | |
| 816 | D141A_E143A_Y261A_L409S_Y410A_P411G_R611M | |
| 817 | D141A_E143A_Y261A_L409S_Y410A_P411G_K673R | |
| 818 | V93Y_D141A_E143A_Y261A_L409S_Y410A_P411G_Y481F_D671R | |
| 819 | D141A_E143A_Y261A_L409S_Y410A_P411G_D648C | |

FIG. 31E

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 820 | V93Y_D141A_E143A_N213E_F214V_Y261A_L409S_Y410A_P411G_D671R | + |
| 821 | D141A_E143A_Y261A_L409S_Y410A_P411G_E620D_E632G_N734Y | |
| 822 | Y7F_D141A_E143A_Y261A_Y362I_L409A_Y410A_P411A_A485S_S492G_Y493I | |
| 823 | D141A_E143A_Y261A_L409S_Y410A_P411G_R612S | |
| 824 | V93Y_D141A_E143A_Y261A_T267Y_I268W_L409S_Y410A_P411G_D671R | |
| 825 | V93Y_D141A_E143A_Y261A_T272W_L409S_Y410A_P411G_D671R | |
| 826 | Y7F_D141A_E143A_Y261A_L409F_Y410F_P411L | |
| 827 | D141A_E143A_Y261A_M329S_L409S_Y410A_P411G | |
| 828 | D141A_E143A_Y261A_L409S_Y410A_P411G_I488T | + |
| 829 | E10V_R119H_D141A_E143A_Y261A_L409S_Y410A_P411G_A485S | |
| 830 | D141A_E143A_L409S_S492G_Y493I | |
| 831 | D141A_E143A_S237G_Y261A_F283L_Y311F_L409S_Y410A_P411G | |
| 832 | E10K_R119C_K136E_D141A_E143A_Y261A_L409S_Y410A_P411G_A485S | |
| 833 | D141A_E143A_Y261A_T272E_L409S_Y410A_P411G | |
| 834 | D141A_E143N_Y261A_L409S_Y410A_P411G | ++ |
| 835 | D141A_E143A_Y261A_L409S_Y410A_P411A_T514S | |
| 836 | R119A_D141A_E143A_Y261A_L409S_Y410A_P411G | |
| 837 | D6S_D141A_E143A_Y261A_Y385R_L409S_Y410A_P411G_V679S | |

FIG. 31F

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 838 | V93Y_D141A_E143A_Y261A_T267F_I268F_L409S_Y410A_P411G_D671R | |
| 839 | Y7F_D141A_E143A_Y261A_L409F_Y410F | |
| 840 | D141A_E143A_Y261A_T267V_I268V_L409S_Y410A_P411G | |
| 841 | V93Y_D141A_E143A_Y261A_I268M_L409S_Y410A_P411G_Y481W_D671R | |
| 842 | D141A_E143A_Y261A_L333A_L409S_Y410A_P411G | + |
| 843 | D141A_E143A_Y261A_L409F_Y410A_P411A_A485S | |
| 844 | D141A_E143A_Y261A_Y410G_P411V | |
| 845 | Y7F_D141A_E143A_Y261A_L409F_Y410F_P411A | |
| 846 | Y7F_D141A_E143A_Y261A_L409F_Y410T_V642A | |
| 847 | Y7F_D141A_E143A_Y261A_L409F_Y410F_P411A_V642A | |
| 848 | I16T_F87C_D141A_E143A_Y261A_L409S_Y410A_P411G_A485S | |
| 849 | Y7F_D141A_E143A_Y261A_L409T_Y410I_V641A | |
| 850 | V93Y_D141A_E143A_Y261A_I268A_L409S_Y410A_P411G_Y481W_D671R | |
| 851 | D141A_E143A_Y261A_L409S_Y410A_P411G_D671A | + |
| 852 | D141A_E143A_Y261A_L333I_L409S_Y410A_P411G | + |
| 853 | V93Y_D141A_E143A_Y261A_T267Y_I268Y_L409S_Y410A_P411G_D671R | |
| 854 | Y7F_K72H_R119H_D141A_E143A_Y261A_Y362I_L409A_Y410A_P411A_A485S | |
| 855 | V93A_D141A_E143A_Y261A_L409S_Y410A_P411G_D671R | ++ |

FIG. 31G

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 856 | V93Y_D141A_E143A_Y261A_T267A_I268F_L409S_Y410A_P411G_D671R | |
| 857 | V93A_D141A_E143A_Y261A_L409S_Y410A_P411G | |
| 858 | Y7F_D141A_E143A_Y261A_L409I_Y410F | |
| 859 | Y7F_D141A_E143A_Y261A_L409F_Y410F_P411L_V642A | |
| 860 | D141A_E143A_C223V_Y261A_L409S_Y410A_P411G_C509V_E620C | |
| 861 | D141A_E143A_Y261A_L409S_Y410A_P411A_T514G | |
| 862 | D141A_E143A_C223V_Y261A_L409S_Y410A_P411G_C509V_E616C | |
| 863 | D141A_E143A_Y261A_I268Y_L409S_Y410A_P411G | |
| 864 | Y7F_D141A_E143A_Y261A_L409F_Y410N_V642A | |
| 865 | Y7F_D141A_E143A_Y261A_L409F_Y410N_P411L_V642A | |
| 866 | P36K_D141A_E143A_Y261A_L409S_Y410A_P411G | |
| 867 | D141A_E143A_Y261A_L409S_Y410G_S492G_Y493I | |
| 868 | D141A_E143A_Y261A_L409S_Y410A_P411G_K670S | + |
| 869 | V93Y_D141A_E143A_Y261A_T267Y_I268F_L409S_Y410A_P411G_D671R | |
| 870 | D141A_E143A_Y261A_L409S_Y410A_P411G_Q664L_K670R_I690V_K704N | |
| 871 | D141A_E143A_Y261A_L409S_Y410A_P411G_E454T | |
| 872 | R17C_A40T_D141A_E143A_Y261A_L409S_Y410A_P411G_A485S | |
| 873 | Y7F_D141A_E143A_Y261A_L409V_Y410M | |

FIG. 31H

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 874 | V93Y_D141A_E143A_Y261A_T272R_L409S_Y410A_P411G_D671R | |
| 875 | D141A_E143A_Q242S_Y261A_L409S_Y410A_P411G | |
| 876 | I16T_E25K_D50N_H59Y_V93A_L126Q_D141A_E143A_Y261A_L409S_Y410A_P411G_A485S | |
| 877 | V93K_D141A_E143A_Y261A_L409S_Y410A_P411G | |
| 878 | Y7F_D141A_E143A_Y261A_L409L_Y410I | |
| 879 | D141A_E143A_Y261A_L409S_Y410A_P411G_D671N | + |
| 880 | R119K_D141A_E143A_Y261A_L409S_Y410A_P411G | |
| 881 | D141A_E143A_Y261A_M329W_L409S_Y410A_P411G | |
| 882 | Y7F_I122V_D141A_E143A_Y362I_Y410A | |
| 883 | Y7F_D141A_E143A_Y261A_L409F_Y410I_P411A | |
| 884 | V93Y_D141A_E143A_Y261A_T267F_I268M_L409S_Y410A_P411G_D671R | |
| 885 | N33S_R67C_E81V_I100T_D141A_E143A_Y261A_L409S_Y410A_P411G | |
| 886 | D141A_E143A_Y261A_L409S_Y410A_P411G_I488M | + |
| 887 | Y7F_D141A_E143A_Y261A_L409F_Y410M_P411L_V642A | |
| 888 | D141A_E143A_Y261A_L409F_Y410A_A485S | |
| 889 | D141L_E143A_Y261A_L409S_Y410A_P411G | ++ |
| 890 | R119M_D141A_E143A_Y261A_L409S_Y410A_P411G | |
| 891 | D141A_E143A_L409S_S492G | |
| 892 | I54F_I80F_A105S_D141A_E143A_Y261A_L409S_Y410A_P411G_A485S | |
| 893 | D141I_E143A_Y261A_L409S_Y410A_P411G | 0 |

FIG. 31I

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 894 | D141A_E143A_Y261A_L409S_Y410A_P411G_E454N | |
| 895 | D141A_E143A_Y261A_L409A_Y410A_P411A_A485S_S492G | |
| 896 | Y7F_D141A_E143A_Y362I_Y410A | |
| 897 | D141A_E143A_Y261A_T272C_L409S_Y410A_P411G | |
| 898 | Y7F_D141A_E143A_Y261A_Y362I_L409F_Y410A_P411G_A485S | |
| 899 | Y7F_D141A_E143A_Y261A_L409N_Y410D | |
| 900 | V93Y_D141A_E143A_Y261A_T267M_I268W_L409S_Y410A_P411G_D671R | |
| 901 | D141A_E143F_Y261A_L409S_Y410A_P411G | ++ |
| 902 | D141A_E143A_F214V_Y261A_L409S_Y410A_P411G | + |
| 903 | F87L_D141A_E143A_Y261A_L409S_Y410A_P411G_A485S | |
| 904 | Y7F_D141A_E143A_Y261A_L409I_Y410D | |
| 905 | G24S_R119C_D141A_E143A_Y261A_L409S_Y410A_P411G_A485S | |
| 906 | D4N_G77S_I96S_P104L_V127M_D141A_E143A_Y261A_L409S_Y410A_P411G_A485S | |
| 907 | Y7F_D141A_E143A_Y261A_L409F_Y410M | |
| 908 | P94Y_D141A_E143A_Y261A_L409S_Y410A_P411G | |
| 909 | V93Y_D141A_E143A_Y261A_T272N_L409S_Y410A_P411G_D671R | |
| 910 | D141A_E143A_C223V_Y261A_L409S_Y410A_P411G_R465C_C509V | |
| 911 | D141A_E143A_Y261A_L409S_Y410A_P411G_K487R | |
| 912 | Y7F_D141A_E143A_Y261A_Y362I_L409S_Y410G | |

FIG. 31J

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 913 | V93Y_D141A_E143A_Y261A_Y385R_L409S_Y410A_P411G_D671R | + |
| 914 | D141A_E143A_Y261A_L409S_Y410A_P411G_Q686R_Q757H | |
| 915 | Y7F_D141A_E143A_Y261A_L409F_Y410I_V642A | |
| 916 | D141F_E143A_Y261A_L409S_Y410A_P411G | ++ |
| 917 | D141A_E143A_Y261A_L409S_Y410A_P411G_T514G | |
| 918 | D141V_E143A_Y261A_L409S_Y410A_P411G | ++ |
| 919 | V93Y_D141A_E143A_Y261A_L409S_Y410A_P411G_R612M_D671R | |
| 920 | Q91W_D141A_E143A_Y261A_L409S_Y410A_P411G | |
| 921 | D141A_E143A_F214A_Y261A_L409S_Y410A_P411G | + |
| 922 | D6S_V93Y_D141A_E143A_Y261A_Y385R_L409S_Y410A_P411G_V679S | |
| 923 | V93Y_D141A_E143A_Y261A_L409S_Y410A_P411G_Y481A_D671R | |
| 924 | Q91H_V93Y_D141A_E143A_Y261A_L409S_Y410A_P411G | |
| 925 | D141A_E143A_Y261A_L409S_Y410A_P411G_A674T_G689D | |
| 926 | D141A_E143A_Y261A_V278M_E288K_L409S_Y410A_P411G | |
| 927 | D141A_E143A_Y261A_L409S_Y410A_P411G_I488V | |
| 928 | V93Y_P115S_D141A_E143A_Y261A_L409S_Y410A_P411G_E663S | |
| 929 | D141A_E143A_S237C_Y261A_L409S_Y410A_P411G | |
| 930 | R58C_I109F_K124R_E133K_D141A_E143A_Y261A_L409S_Y410A_P411G_A485S | |

FIG. 31K

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 931 | D141A_E143A_Y261A_L409S_Y410A_P411G_E454D | |
| 932 | D141A_E143A_Y261A_V282G_L409S_Y410A_P411G | |
| 933 | D141A_E143A_K240E_Y261T_P262L_A292T_L409S_Y410A_P411G | |
| 934 | D141A_E143A_Y261A_L409S_Y410A_P411G_E668G | + |
| 935 | D141A_E143A_Y261A_L409S_Y410A_P411G_A687C | |
| 936 | P90L_D141A_E143A_Y261A_L409S_Y410A_P411G_A485S | |
| 937 | V93Y_D141A_E143A_Y261A_T267W_I268F_L409S_Y410A_P411G_D671R | |
| 938 | Y7F_D141A_E143A_Y261A_L409F_Y410M_P411A_V642A | |
| 939 | D141A_E143A_Y261A_L409S_Y410A_P411G_E668D | + |
| 940 | D141A_E143A_Y261A_L409F_Y410A_P411G_A485S_S492G | |
| 941 | D141A_E143A_Y261A_L409F_Y410A_P411G_A485S_S492G_Y493I | |
| 942 | D141A_E143I_Y261A_L409S_Y410A_P411G | ++ |
| 943 | D141A_E143A_C223V_Y261A_L409S_Y410A_P411G_Y481C_C509V | |
| 944 | Y7F_D141A_E143A_Y261A_L409F_Y410D_P411A | |
| 945 | Y7F_D141A_E143A_Y261A_L409L_Y410M | |
| 946 | D141A_E143A_Y261A_L409S_Y410A_P411G | + |
| 947 | D141A_E143A_Y261A_L409S_Y410A_P411G_R612N | |
| 948 | D141A_E143A_Y261A_V282L_L409S_Y410A_P411G | |
| 949 | Y7F_D141A_E143A_Y261A_L409N_Y410N | |

FIG. 31L

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 950 | Y7A_D141A_E143A_Y261A_L409S_Y410A_P411G | |
| 951 | D141A_E143A_Y218H_C223S_Y261A_L409S_Y410A_P411G | |
| 952 | D141A_E143A_Y261A_L409A_Y410A_T514G | |
| 953 | V93G_D141A_E143A_Y261A_L409S_Y410A_P411G | |
| 954 | D141A_E143A_Y261A_L409S_Y410G_S492G | |
| 955 | V93Y_D141A_E143A_Y261A_T267W_L409S_Y410A_P411G_D671R | |
| 956 | D141A_E143A_Y261A_L409S_Y410A_P411G_K673S | |
| 957 | Y7F_V82A_L85A_D141A_E143A_Y261A_Y362I_L409A_Y410A_P411A_A485S | |
| 958 | I114A_D141A_E143A_Y261A_L409S_Y410A_P411G | |
| 959 | V93Y_D141A_E143A_Y261A_T267F_I268Y_L409S_Y410A_P411G_D671R | |
| 960 | D141A_E143A_Y261A_L409Y_Y410G_P411V | |
| 961 | D141A_E143A_Y261A_L409S_Y410A_P411G_K707G | |
| 962 | Y7F_D141A_E143A_Y362I_L409S | |
| 963 | D141A_E143A_Y261A_L409S_Y410A_P411G_E475^ | |
| 964 | Q91N_D141A_E143A_Y261A_L409S_Y410A_P411G | |
| 965 | Y7F_D141A_E143A_Y261A_L409S_Y410A_A485S | |
| 966 | V93Y_D141A_E143A_Y261A_T267M_I268Y_L409S_Y410A_P411G_D671R | |
| 967 | Y7F_D141A_E143A_Y261A_L409F_Y410I_P411L | |
| 968 | R58C_I65F_R107C_M129L_D141A_E143A_Y261A_L409S_Y410A_P411G_A485S | |

FIG. 31M

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 969 | P90V_D141A_E143A_Y261A_L409S_Y410A_P411G | |
| 970 | D141A_E143A_Y261A_L409F_Y410G_P411I | |
| 971 | V93Y_D141A_E143A_Y261A_K289Q_L409S_Y410A_P411G_D671R | ++ |
| 972 | D141A_E143A_Y261A_L409S_Y410A_P411G_E668N | + |
| 973 | V93(del)_D141A_E143A_Y261A_L409S_Y410A_P411G | |
| 974 | D6S_Y7F_D141A_E143A_Y261A_L409F_Y410A_P411A_K429R_E663S | |
| 975 | V93Y_D141A_E143A_Y261A_T267V_I268Y_L409S_Y410A_P411G_D671R | |
| 976 | D141A_E143A_Y261A_L409S_Y410A_P411G_K487N | + |
| 977 | Y7F_D141A_E143A_Y261A_L409L_Y410F | |
| 978 | D141A_E143A_Y261A_Y410A_P411V | |
| 979 | P36V_D141A_E143A_Y261A_L409S_Y410A_P411G | |
| 980 | D141A_E143A_Y261A_Y410G_P411A | |
| 981 | D141A_E143A_D246L_Y261A_L409S_Y410A_P411G | |
| 982 | Y7F_D141A_E143A_Y261A_L409F_Y410T_P411A | |
| 983 | D141A_E143A_C223V_Y261A_L409S_Y410A_P411G_C509V_A687C | |
| 984 | D141A_E143A_C223V_Y261A_L409S_Y410A_P411G_I474C_C509V | |
| 985 | V93Y_D141A_E143A_Y261A_L409S_Y410A_P411G | |
| 986 | R97H_F110L_M129V_D141A_E143A_Y261A_L409S_Y410A_P411G_A485S | |
| 987 | D4A_D141A_E143A_E251A_Y261A_D343A_L409S_Y410A_P411G | |

FIG. 31N

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 988 | D141A_E143A_Y410A_S492G | |
| 989 | D141A_E143A_Y261A_L409A_Y410A_P411A_A485S_Y493I | |
| 990 | D141A_E143A_Y261A_Y410A_P411I | |
| 991 | D141A_E143A_Y261A_T267M_I268W_L409S_Y410A_P411G | |
| 992 | D141A_E143A_Y261A_T267Y_I268V_L409S_Y410A_P411G | |
| 993 | D141A_E143A_Y261A_L409S_Y410A_P411G_I488A | + |
| 994 | Q91L_V93A_D141A_E143A_Y261A_L409S_Y410A_P411G | |
| 995 | Y7F_D141A_E143A_Y261A_L409F_Y410D_V642A | |
| 996 | D141A_E143A_Y261A_L409S_Y410A_P411G_K673Y | |
| 997 | D141A_E143A_C223V_Y261A_L409S_Y410A_P411G_C509V_A623C | |
| 998 | V93Y_D141A_E143A_Y261A_S347R_L409S_Y410A_P411G_D671R | + |
| 999 | D141A_E143A_Y261A_V282T_L409S_Y410A_P411G | |
| 1000 | Y7F_D141A_E143A_Y261A_Y362I_L409A_Y410A_P411A_A485S | |
| 1001 | D141A_E143A_Y261A_T267V_I268Y_L409S_Y410A_P411G | |
| 1002 | D141A_E143A_Y261A_L409S_Y410A_P411G_K693V | |
| 1003 | V93Y_D141A_E143A_Y261A_I268W_L409S_Y410A_P411G_Y481T_D671R | |
| 1004 | Y7F_D141A_E143A_Y261A_L409F_Y410L_P411A | |
| 1005 | D141A_E143A_Y261A_T272R_L409S_Y410A_P411G | |

FIG. 3IO

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1006 | Y7F_D141A_E143A_Y261A_L409F_Y410L_P411A_V642A | |
| 1007 | D141A_E143A_C223V_Y261A_L409S_Y410A_P411G_K464C_C509V | |
| 1008 | F116A_D141A_E143A_Y261A_L409S_Y410A_P411G | |
| 1009 | D141A_E143A_Y410A_P411G | |
| 1010 | Y7F_D141A_E143A_Y261A_L409I_Y410L | |
| 1011 | P90T_D141A_E143A_Y261A_L409S_Y410A_P411G | |
| 1012 | D141A_E143A_Y261A_L409S_Y410A_P411G_D671S | + |
| 1013 | D141A_E143A_Y261A_L409S_Y410A_P411G_I709L | |
| 1014 | D141A_E143A_Y261A_Y410A | + |
| 1015 | Y7F_D141A_E143A_Y261A_L409V_Y410T | |
| 1016 | Y7F_D141A_E143A_Y261A_L409F_Y410I | |
| 1017 | Y7F_D141A_E143A_Y261A_L409V_Y410L | |
| 1018 | V93Y_D141A_E143A_Y261A_I268V_L409S_Y410A_P411G_Y481T_D671R | |
| 1019 | D141A_E143A_Y261A_L409S_Y410A_P411G_E668A | + |
| 1020 | Y7F_D141A_E143A_Y261A_L409F_Y410N_P411A | |
| 1021 | V93T_D141A_E143A_Y261A_L409S_Y410A_P411G | |
| 1022 | D44G_H59L_W83R_I114T_A117T_D141A_E143A_Y261A_L409S_Y410A_P411G_A485S | |
| 1023 | V93Y_D141A_E143A_Y261A_L409S_Y410A_P411G_Y481W_D671R | |
| 1024 | D141A_E143A_Y261A_L409S_Y410A_P411G_E668S | + |
| 1025 | D141A_E143A_Y261A_L409S_Y410A_P411G_I635T_D648G | |
| 1026 | D141A_E143A_Y261A_L409S_Y410A_P411G_Y481^ | |

FIG. 31P

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1027 | D141A_E143A_Y261A_L409S_Y410A_P411G_V415R | |
| 1028 | V93Y_D141A_E143A_Y261A_T267Y_I268M_L409S_Y410A_P411G_D671R | |
| 1029 | Y7F_D141A_E143A_Y261A_L409F_Y410T | |
| 1030 | R119G_D141A_E143A_Y261A_L409S_Y410A_P411G | |
| 1031 | D141A_E143A_Y261A_L409S_Y410A_P411A_T514A | |
| 1032 | D141A_E143A_Y261A_L409S_Y410A_P411G_T514S | |
| 1033 | Y7F_D141A_E143A_Y261A_L409I_Y410T | |
| 1034 | V93S_D141A_E143A_Y261A_L409S_Y410A_P411G | |
| 1035 | V93Y_D141A_E143A_Y261A_L409S_Y410A_P411G_R612L_D671R | |
| 1036 | D141A_E143A_Y261A_L409S_Y410A_P411G_I474C | |
| 1037 | D141A_E143A_Y261A_L409S_Y410A_P411G_E668M | |
| 1038 | D141A_E143A_Y261A_Y362I_L409S_Y410A_P411A | |
| 1039 | D141A_E143A_Y410A_S492G_Y493I | |
| 1040 | D141A_E143A_D246R_Y261A_L409S_Y410A_P411G | |
| 1041 | D141A_E143A_C223V_Y261A_L409S_Y410A_P411G_E475C_C509V | |
| 1042 | D141A_E143A_Y261A_L409S_Y410A_P411G_I488S | + |
| 1043 | Y7F_D141A_E143A_Y261A_L409L_Y410D | |

FIG. 31Q

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1044 | E22K_L85Q_D141A_E143A_Y261A_L409S_Y410A_P411G_A485S | |
| 1045 | D141A_E143A_Y261A_L409A_Y410A_P411A_A485S_S492G_Y493I | |
| 1046 | D141A_E143A_C223V_Y261A_L409S_Y410A_P411G_C509V_Q686C | |
| 1047 | D141A_E143A_Y261A_L409S_Y410A_P411G_V415N | |
| 1048 | K20E_A117T_G131S_D141A_E143A_Y261A_L409S_Y410A_P411G_A485S | |
| 1049 | Y7F_D141A_D143A_Y261A_L409V_Y410L_P411A_A485L | |
| 1050 | D141A_E143A_Y261A_L409S_Y410A_P411G_Y652F | ++ |
| 1051 | Y7F_D141A_D143A_Y261A_S408G_S412G_A485L | |
| 1052 | Y7F_D141A_D143A_Y261A_Y410M_A485L_T514A | |
| 1053 | V93Y_D141A_E143A_Y261A_L409S_Y410A_P411G_C509N_S512R_D671R | |
| 1054 | D141A_E143A_Y261A_L409S_Y410A_P411G_M770S | ++ |
| 1055 | V93Y_D141A_E143A_Y261A_L409S_Y410A_P411G_D671R_Y756^ | ++ |
| 1056 | V93Y_D141A_E143A_Y261A_L409S_Y410A_P411G_C509D_S512R_D671R | |
| 1057 | D141A_E143A_Y261A_L409S_Y410A_P411G_W767^ | ++ |
| 1058 | V93Y_D141A_E143A_Y261A_L409S_Y410A_P411G_C509Q_S512D_D671R | |
| 1059 | D141A_E143A_Y261A_L409S_Y410A_P411G_D613Y | ++ |
| 1060 | D141A_E143A_C223M_Y261A_L409S_Y410A_P411G_D671R | ++ |

FIG. 31R

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1061 | V93Y_D141A_E143A_Y261A_L409S_Y410A_P411G_S512F_D671R | |
| 1062 | D141A_E143A_C223L_Y261A_L409S_Y410A_P411G_D671R | + |
| 1063 | I80S_V93Y_D141A_E143A_Y261A_L409S_Y410A_P411G_D671R | |
| 1064 | Y7F_D141A_D143A_Y261A_L409V_Y410L_P411T_A485L | |
| 1065 | V93Y_D141A_E143A_Y261A_L409S_Y410A_P411G_C509N_S512K_D671R | |
| 1066 | Y7F_D141A_D143A_Y261A_L409V_Y410A_A485L_T514S | |
| 1067 | D141A_E143A_Y261A_L409S_Y410A_P411G_D613E | ++ |
| 1068 | Y7F_D141A_D143A_Y261A_A485L_T514A | |
| 1069 | D141A_E143A_Y261A_L409S_Y410A_P411G_C509S_D671R | ++ |
| 1070 | Y7F_D141A_D143A_Y261A_Y410T_A485L_N491A_T514S | |
| 1071 | Y7F_D141A_D143A_Y261A_P411A_A485L | |
| 1072 | Y7F_D141A_D143A_Y261A_Y410F_P411T_A485L | |
| 1073 | D141A_E143A_Y261A_L409S_Y410A_P411G_M759T | ++ |
| 1074 | Y7F_D141A_D143A_Y261A_L409V_Y410L_A485L_T514S | |
| 1075 | D141A_E143A_Y261A_L409S_Y410A_P411G_V535S | ++ |
| 1076 | Y7F_D141A_D143A_Y261A_L409I_Y410S_A485L_T514A | |
| 1077 | Y7F_D141A_D143A_Y261A_Y410L_A485L_T514A | |
| 1079 | V93Y_D141A_E143A_Y261A_L409S_Y410A_P411G_C509N_S512W_D671R | |

FIG. 31S

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1080 | Y7F_D141A_D143A_Y261A_L409I_Y410E_P411L_A485L | |
| 1081 | Y7F_D141A_D143A_Y261A_Y410T_A485L_T514S | |
| 1082 | Y7F_D141A_D143A_Y261A_L409I_Y410M_A485L_T514S | |
| 1083 | D141A_E143A_Y261A_L409S_Y410A_P411G_D613A | ++ |
| 1084 | Y7F_D141A_D143A_Y261A_S412A_A485L | |
| 1085 | Y7F_D141A_D143A_Y261A_Y410T_A485L_T514S_G517V | |
| 1086 | D141A_E143A_Y261A_L409S_Y410A_P411G_M759S | ++ |
| 1087 | V93Y_D141A_E143A_Y261A_L409S_Y410A_P411G_D671R_M759S | ++ |
| 1088 | D141A_E143A_Y261A_L409S_Y410A_P411G_V535R | |
| 1089 | Y7F_D141A_D143A_Y261A_P411T_A485L_N491I | |
| 1090 | D141A_E143A_Y261A_L409S_Y410A_P411G_V642I_D671R | + |
| 1091 | V93Y_D141A_E143A_Y261A_L409S_Y410A_P411G_C509D_S512H_D671R | |
| 1092 | Y7F_D141A_D143A_Y261A_L409V_Y410L_P411S_A485L | |
| 1093 | V93Y_D141A_E143A_Y261A_L409S_Y410A_P411G_C509N_D671R | |
| 1094 | V93Y_D141A_E143A_Y261A_L409S_Y410A_P411G_S512D_D671R | |
| 1095 | V93Y_D141A_E143A_Y261A_L409S_Y410A_P411G_D671R_Y756K | + |
| 1096 | Y7F_D141A_D143A_Y261A_P411S_A485L_N491A | |

FIG. 31T

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1097 | Y7F_D141A_D143A_Y261A_Y410L_A485L_T514S | |
| 1098 | D141A_E143A_Y261A_L409S_Y410A_P411G_W767F | |
| 1099 | Y7F_D141A_D143A_Y261A_A485L_N491T | |
| 1100 | V93Y_D141A_E143A_G245S_Y261A_L409S_Y410A_P411G_D671R | + |
| 1101 | D141A_E143A_Y261A_L409S_Y410A_P411G_Y756^ | ++ |
| 1102 | V93Y_D141A_E143A_Y261A_L409S_Y410A_P411G_S512E_D671R | |
| 1103 | V93Y_D141A_E143A_Y261A_L409S_Y410A_P411G_S506T_D671R | |
| 1104 | Y7F_D141A_D143A_Y261A_L409I_Y410F_A485L_T514A | |
| 1105 | Y7F_D141A_D143A_Y261A_Y410S_A485L_T514A | |
| 1106 | Y7F_D141A_D143A_Y261A_Y410F_P411S_A485L | |
| 1107 | D141A_E143A_K192L_Y261A_L409S_Y410A_P411G_D671R | ++ |
| 1108 | V93Y_D141A_E143A_Y261A_L409S_Y410A_P411G_D671R_M759^ | ++ |
| 1109 | Y7F_D141A_D143A_Y261A_Y410E_A485L_T514A | |
| 1110 | Y7F_D141A_D143A_Y261A_P411V_A485L | |
| 1111 | V93Y_D141A_E143A_Y261A_L409S_Y410A_P411G_C509D_S512W_D671R | |
| 1112 | Y7F_D141A_D143A_Y261A_Y410T_A485L_V513L | |
| 1113 | V93Y_D141A_E143A_Y261A_L409S_Y410A_P411G_D671R_W767Y | ++ |
| 1114 | D141A_E143A_Y261A_L409S_Y410A_P411G_W767S | ++ |

FIG. 31U

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1115 | V93Y_D141A_E143A_Y261A_L409S_Y410A_P411G_D671R_M770N | ++ |
| 1116 | Y7F_D141A_D143A_Y261A_A485L_Y494W | |
| 1117 | Y7F_D141A_D143A_Y261A_L409I_Y410T_A485L_T514A | |
| 1118 | V93Y_D141A_E143A_Y261A_L409S_Y410A_P411G_D671R_Y756Q | ++ |
| 1119 | D141A_E143A_Y261A_L409S_Y410A_P411G_S506L_D671R | ++ |
| 1120 | D141N_E143A_Y261A_M329L_L409S_Y410A_P411G_D671R | + |
| 1121 | Y7F_D141A_D143A_Y261A_Y410T_A485L_G517A | |
| 1122 | V93Y_D141A_E143A_Y261A_L409S_Y410A_P411G_C509Q_S512W_D671R | |
| 1123 | Y7F_D141A_D143A_Y261A_L409I_Y410D_A485L_T514S | |
| 1124 | V93Y_D141A_E143A_Y261A_L409S_Y410A_P411G_C509Q_S512K_D671R | |
| 1125 | Y7F_D141A_D143A_Y261A_L409I_Y410D_A485L_T514A | |
| 1126 | Y7F_D141A_D143A_Y261A_P411A_A485L_N491T | |
| 1127 | Y7F_D141A_D143A_Y261A_Y410D_A485L_T514S | |
| 1128 | Y7F_D141A_D143A_Y261A_L409V_Y410M_A485L_T514A | |
| 1129 | D141A_E143A_Y261A_L409S_Y410A_P411G_D613F_D671R | ++ |
| 1130 | V93Y_D141A_E143A_C223V_Y261A_L409S_Y410A_P411G_D671R | |
| 1131 | D141A_E143A_Y261A_L409S_Y410A_P411G_Y756Q | ++ |
| 1132 | V93Y_D141A_E143A_Y261A_L409S_Y410A_P411G_C509H_D671R | |

FIG. 31V

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1133 | D141A_E143A_Y261A_L409S_Y410A_P411G_D613R | ++ |
| 1134 | D141A_E143A_Y261A_M329L_L409S_Y410A_P411G_D671R_R758STOP | ++ |
| 1135 | Y7F_D141A_D143A_Y261A_A485L_G517A | |
| 1136 | Y7F_D141A_D143A_Y261A_Y410F_P411A_A485L | |
| 1137 | I80N_V93Y_D141A_E143A_Y261A_L409S_Y410A_P411G_D671R | + |
| 1138 | D141A_E143N_Y261A_L409S_Y410A_P411G_D671R | ++ |
| 1139 | V93F_D141A_E143A_Y261A_P262R_L409S_Y410A_P411G_D671R | |
| 1140 | V93Y_D141A_E143A_Y261A_L409S_Y410A_P411G_S506R_D671R | |
| 1141 | Y7F_D141A_D143A_Y261A_Y410M_A485L_T514S | |
| 1142 | V93Y_D141A_E143A_Y261A_L409S_Y410A_P411G_D671R_M759N | ++ |
| 1143 | Y7F_D141A_D143A_Y261A_Y410V_A485L_T514S | |
| 1144 | D141A_E143A_Y261A_L409S_Y410A_P411G_M770^ | ++ |
| 1145 | D141A_E143A_Y261A_L409S_Y410A_P411G_W767Y | ++ |
| 1146 | Y7F_D141A_D143A_Y261A_L409V_Y410F_A485L_T514A | |
| 1147 | D141A_E143A_Y261A_L409S_Y410A_P411G_E529N | ++ |
| 1148 | D141A_E143A_Y261A_M329L_L409S_Y410A_P411G_E668K | ++ |
| 1149 | Y7F_D141A_D143A_Y261A_Y410T_A485L_T514S_G517S | |
| 1150 | Y7F_D141A_D143A_Y261A_L409V_Y410L_P411V_A485L | |

FIG. 31W

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1151 | V93Y_D141A_E143A_Y261A_L409S_Y410A_P411G_C509Q_S512H_D671R | |
| 1152 | V93Y_D141A_E143A_C223K_Y261A_L409S_Y410A_P411G_D671R | |
| 1153 | Y7F_D141A_D143A_Y261A_Y410T_A485L_T514S_G517T | |
| 1154 | D141A_E143A_Y261A_L409S_Y410A_P411G_D613S_D671R | ++ |
| 1155 | I80R_V93Y_D141A_E143A_Y261A_L409S_Y410A_P411G_D671R | + |
| 1156 | D141A_E143A_Y261A_L409S_Y410A_P411G_Q497M_D671R | ++ |
| 1157 | Y7F_D141A_D143A_Y261A_Y410F_A485L_T514S | |
| 1158 | Y7F_D141A_D143A_Y261A_L409V_Y410T_A485L_T514A | |
| 1159 | D141A_E143A_Y261A_L409S_Y410A_P411G_Y652C | ++ |
| 1160 | V93Y_D141A_E143A_Y261A_L409S_Y410A_P411G_S506A_D671R | |
| 1161 | V93Y_D141A_E143A_Y261A_L409S_Y410A_P411G_D671R_M770T | + |
| 1162 | V93Y_D141A_E143A_G245K_Y261A_L409S_Y410A_P411G_D671R | ++ |
| 1163 | D141A_E143A_Y261A_L409S_Y410A_P411G_D613N | ++ |
| 1164 | V93Y_D141A_E143A_Y261A_L409S_Y410A_P411G_V535K_D671R | ++ |
| 1165 | Y7F_D141A_D143A_Y261A_L409V_Y410S_A485L_T514S | |
| 1166 | Y7F_D141A_D143A_Y261A_S408A_S412A_A485L | |
| 1167 | Y7F_D141A_D143A_Y261A_P411T_A485L | |
| 1168 | I80N_D141A_E143A_Y261A_L409S_Y410A_P411G | |

FIG. 31X

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1169 | D141A_E143A_Y261A_L409S_Y410A_P411G_D613F | ++ |
| 1170 | D141A_E143A_G245N_Y261A_L409S_Y410A_P411G | ++ |
| 1171 | Y7F_D141A_D143A_Y261A_L409I_Y410L_A485L_T514A | |
| 1172 | Y7F_D141A_D143A_Y261A_Y410F_P411V_A485L | |
| 1173 | Y7F_D141A_D143A_Y261A_Y410A_A485L_T514A | |
| 1174 | Y7F_D141A_D143A_Y261A_Y410T_A485L_V513I_T514S | |
| 1175 | Y7F_D141A_D143A_Y261A_L409V_Y410A_A485L_T514A | |
| 1176 | Y7F_D141A_D143A_Y261A_A485L_V513M | |
| 1177 | V93Y_D141A_E143A_Y261A_L409S_Y410A_P411G_K534N_D671R | + |
| 1178 | Y7F_D141A_D143A_Y261A_Y410A_A485L_T514S | |
| 1179 | Y7F_D141A_D143A_Y261A_Y410T_A485L_T514A | |
| 1180 | D141A_E143A_Y261A_L409S_Y410A_P411G_D613E_D671R | ++ |
| 1181 | D141A_E143A_Y261A_L409S_Y410A_P411G_M770T | ++ |
| 1182 | V93Y_D141A_E143A_C223P_Y261A_L409S_Y410A_P411G_D671R | |
| 1183 | Y7F_D141A_D143A_Y261A_A485L_N491S | |
| 1184 | D141A_E143A_Y261A_L409S_Y410A_P411G_M770N | ++ |
| 1185 | Y7F_D141A_D143A_Y261A_Y410T_A485L_V513M | |
| 1186 | V93Y_D141A_E143A_Y261A_L409S_Y410A_P411G_C509D_S512F_D671R | |

FIG. 31Y

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1187 | V93Y_D141A_E143A_Y261A_L409S_Y410A_P411G_C509N_S512F_D671R | |
| 1188 | Y7F_D141A_D143A_Y261A_A485L_G517V | |
| 1189 | Y7F_D141A_D143A_Y261A_Y410T_A485L_G517V | |
| 1190 | D141A_E143A_Y261A_L409S_Y410A_P411G_D613A_D671R | ++ |
| 1191 | D141A_E143A_Y261A_L409S_Y410A_P411G_M759N | ++ |
| 1192 | V93Y_D141A_E143A_Y261A_L409S_Y410A_P411G_K534S_D671R | + |
| 1193 | Y7F_D141A_D143A_Y261A_A485L | |
| 1194 | Y7F_D141A_D143A_Y261A_A485L_N491A | |
| 1195 | D141A_E143A_G245K_Y261A_L409S_Y410A_P411G | ++ |
| 1196 | Y7F_D141A_D143A_Y261A_A485L_V513A | |
| 1197 | V93Y_D141A_E143A_Y261A_L409S_Y410A_P411G_D671R_M770S | ++ |
| 1198 | Y7F_D141A_D143A_Y261A_Y410T_A485L_V513M_T514S | |
| 1199 | D141A_E143A_Y261A_L409S_Y410A_P411G_D613V | ++ |
| 1200 | V93Y_D141A_E143A_Y261A_L409S_Y410A_P411G_D671R_W767^ | ++ |
| 1201 | Y7F_D141A_D143A_Y261A_L409I_Y410A_A485L_T514A | |
| 1202 | V93Y_D141A_E143A_Y261A_L409S_Y410A_P411G_V535R_D671R | |
| 1203 | D141A_E143A_C223A_Y261A_L409S_Y410A_P411G_D671R | ++ |
| 1204 | Y7F_D141A_D143A_Y261A_Y410T_A485L_G517T | |

FIG. 31Z

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1205 | D141A_E143A_Y261A_Y362I_L409S_Y410A_P411G_D671R | ++ |
| 1206 | Y7F_D141A_D143A_Y261A_L409V_Y410M_A485L_T514S | |
| 1207 | V93Y_D141A_E143A_Y261A_L409S_Y410A_P411G_C509N_S512H_D671R | |
| 1208 | Y7F_D141A_D143A_Y261A_L409V_Y410E_A485L_T514S | |
| 1209 | Y7F_D141A_D143A_Y261A_L409V_Y410E_A485L_T514A | |
| 1210 | V93Y_D141A_E143A_Y261A_L409S_Y410A_P411G_C509D_S512K_D671R | |
| 1211 | V93Y_D141A_E143A_C223D_Y261A_L409S_Y410A_P411G_D671R | |
| 1212 | D141A_E143A_Y261A_L409S_Y410A_P411G_A650T_D671R | ++ |
| 1213 | V93Y_D141A_E143A_G245N_Y261A_L409S_Y410A_P411G_D671R | ++ |
| 1214 | Y7F_D141A_D143A_Y261A_L409I_Y410T_A485L_T514S | |
| 1215 | Y7F_D141A_D143A_Y261A_L409V_Y410T_A485L_T514S | |
| 1216 | V93Y_D141A_E143A_Y261A_L409S_Y410A_P411G_C509D_D671R | |
| 1217 | Y7F_D141A_D143A_Y261A_P411V_A485L_N491S | |
| 1218 | D141A_E143A_Y261A_L409S_Y410A_P411G_M759^ | ++ |
| 1219 | Y7F_D141A_D143A_Y261A_Y410L_P411A_A485L | |
| 1220 | Y7F_D141A_D143A_Y261A_L409V_Y410F_A485L_T514S | |
| 1221 | Y7F_D141A_D143A_Y261A_L409V_Y410S_A485L_T514A | |

FIG. 31AA

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1222 | Y7F_D141A_D143A_Y261A_Y410T_A485L_V513F_T514S | |
| 1223 | D141A_E143V_Y261A_L409S_Y410A_P411G_D671R | ++ |
| 1224 | Y7F_D141A_D143A_Y261A_A485L_G517S | |
| 1225 | Y7F_D141A_D143A_Y261A_L409I_Y410A_A485L_T514S | |
| 1226 | D141A_E143A_Y261A_A298G_L409S_Y410A_P411G_D671R | ++ |
| 1227 | Y7F_D141A_D143A_Y261A_Y410T_A485L_N491S_T514S | |
| 1228 | Y7F_D141A_D143A_Y261A_Y410F_A485L_T514A | |
| 1229 | Y7F_D141A_D143A_Y261A_A485L_T514S | |
| 1230 | D141N_E143V_Y261A_L409S_Y410A_P411G | ++ |
| 1231 | Y7F_D141A_D143A_Y261A_Y410T_A485L_V513I | |
| 1232 | V93Y_D141A_E143A_Y261A_L409S_Y410A_P411G_C509Q_S512R_D671R | |
| 1233 | D141A_E143A_Y261A_L409S_Y410A_P411G_K534S | ++ |
| 1234 | Y7F_D141A_D143A_Y261A_L409I_Y410V_A485L_T514A | |
| 1235 | Y7F_D141A_D143A_Y261A_A485L_N491I | |
| 1236 | D141A_E143A_Y261A_L409S_Y410A_P411G_D613Y_D671R | ++ |
| 1237 | D141A_E143A_Y261A_V282L_L409S_Y410A_P411G_D671R | ++ |
| 1238 | Y7F_D141A_D143A_Y261A_A485L_Y493W | |
| 1239 | D141A_E143A_Y261A_L409S_Y410A_P411G_C509M_D671R | ++ |
| 1240 | Y7F_D141A_D143A_Y261A_Y410E_A485L_T514S | |

FIG. 31BB

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1241 | Y7F_D141A_D143A_Y261A_Y410D_A485L_T514A | |
| 1242 | D141A_E143A_C223S_Y261A_L409S_Y410A_P411G_D671R | ++ |
| 1243 | Y7F_D141A_D143A_Y261A_A485L_T514I | |
| 1244 | Y7F_D141A_D143A_Y261A_A485L_Y494F | |
| 1245 | D141N_E143N_Y261A_L409S_Y410A_P411G | ++ |
| 1246 | D141A_E143A_Y261A_L409S_Y410A_P411G_V535N | ++ |
| 1247 | D141A_E143A_G245R_Y261A_L409S_Y410A_P411G | ++ |
| 1248 | Y7F_D141A_D143A_Y261A_L409V_Y410D_A485L_T514S | |
| 1249 | Y7F_D141A_D143A_Y261A_A485L_G517T | |
| 1250 | D141N_E143A_Y261A_L409S_Y410A_P411G_D671R | + |
| 1251 | D141A_E143A_Y261A_L409S_Y410A_P411G_D613N_D671R | ++ |
| 1252 | D141A_E143A_Y261A_L409S_Y410A_P411G_D613R_D671R | ++ |
| 1253 | Y7F_D141A_D143A_Y261A_Y410L_P411V_A485L | |
| 1254 | Y7F_D141A_D143A_Y261A_A485L_V513I | |
| 1255 | V93Y_D141A_E143A_Y261A_L409S_Y410A_P411G_K534R_D671R | |
| 1256 | Y7F_D141A_D143A_Y261A_P411S_A485L | |
| 1257 | I80S_D141A_E143A_Y261A_L409S_Y410A_P411G | ++ |
| 1258 | Y7F_D141A_D143A_Y261A_L409V_Y410V_A485L_T514A | |
| 1259 | I80K_V93Y_D141A_E143A_Y261A_L409S_Y410A_P411G_D671R | + |

FIG. 31CC

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1260 | V93Y_D141A_E143A_Y261A_L409S_Y410A_P411G_V535N_D671R | ++ |
| 1261 | I80R_D141A_E143A_Y261A_L409S_Y410A_P411G | ++ |
| 1262 | Y7F_D141A_D143A_Y261A_L409I_Y410E_A485L_T514S | |
| 1263 | Y7F_D141A_D143A_Y261A_L409I_Y410S_A485L_T514S | |
| 1264 | D141A_E143A_Y261A_L409S_Y410A_P411G_D613V_D671R | ++ |
| 1265 | V93Y_D141A_E143A_Y261A_L409S_Y410A_P411G_D671R_W767F | ++ |
| 1266 | D141A_E143A_Y261A_L409S_Y410A_P411G_S506R_D671R | ++ |
| 1267 | I80K_D141A_E143A_Y261A_L409S_Y410A_P411G | ++ |
| 1268 | D141A_E143A_Y261A_L409S_Y410A_P411G_V535K | ++ |
| 1269 | V93Y_D141A_E143A_Y261A_L409S_Y410A_P411G_D671R_W767H | + |
| 1270 | D141A_E143A_Y261A_L409S_Y410A_P411G_S506A_D671R | ++ |
| 1271 | Y7F_D141A_D143A_Y261A_Y410T_A485L_G517S | |
| 1272 | Y7F_D141A_D143A_Y261A_A485L_V513F | |
| 1273 | Y7F_D141A_D143A_Y261A_L409V_Y410V_A485L_T514S | |
| 1274 | D141A_E143A_Y261A_L409S_Y410A_P411G_V419I_D671R | ++ |
| 1275 | D141A_E143A_Y261A_L409S_Y410A_P411G_D613K | ++ |
| 1276 | Y7F_D141A_D143A_Y261A_L409V_Y410L_A485L_T514A | |
| 1277 | V93Y_D141A_E143A_Y261A_L409S_Y410A_P411G_C509D_S512D_D671R | |

FIG. 31DD

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1278 | Y7F_D141A_D143A_Y261A_A485L_V513S | |
| 1279 | V93Y_D141A_E143A_C223N_Y261A_L409S_Y410A_P411G_D671R | |
| 1280 | Y7F_D141A_D143A_Y261A_Y410L_P411S_A485L | |
| 1281 | Y7F_D141A_D143A_Y261A_Y410S_A485L_T514S | |
| 1282 | Y7F_D141A_D143A_Y261A_A485L_T514V | |
| 1283 | D141A_E143A_Y261A_L409S_Y410A_P411G_D613Q_D671R | ++ |
| 1284 | D141A_E143A_Y261A_L409S_Y410A_P411G_Q497N_D671R | ++ |
| 1285 | Y7F_D141A_D143A_Y261A_I413V_A485L | |
| 1286 | D141A_E143A_Y261A_L409S_Y410A_P411G_D613Q | ++ |
| 1287 | V93Y_D141A_E143A_Y261A_L409S_Y410A_P411G_C509Q_S512F_D671R | |
| 1288 | Y7F_D141A_D143A_Y261A_Y410T_A485L_V513L_T514S | |
| 1289 | Y7F_D141A_D143A_Y261A_L409V_Y410D_A485L_T514A | |
| 1290 | Y7F_D141A_D143A_Y261A_L409I_Y410E_A485L_T514A | |
| 1291 | Y7F_D141A_D143A_Y261A_Y410V_A485L_T514A | |
| 1292 | Y7F_D141A_D143A_Y261A_S412G_A485L | |
| 1293 | V93Y_D141A_E143A_Y261A_L409S_Y410A_P411G_D671R_M759T | 0 |
| 1294 | Y7F_D141A_D143A_Y261A_Y410T_A485L_N491T_T514S | |
| 1295 | D141A_E143A_Y261A_L409S_Y410A_P411G_D613K_D671R | ++ |

FIG. 31EE

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1296 | Y7F_D141A_D143A_Y261A_L409I_Y410V_A485L_T514S | |
| 1297 | V93Y_D141A_E143A_Y261A_L409S_Y410A_P411G_V535S_D671R | ++ |
| 1298 | D141A_E143A_Y261A_V282L_M329L_L409S_Y410A_P411G_D671R | + |
| 1299 | Y7F_D141A_D143A_Y261A_Y410T_A485L_N491I_T514S | |
| 1300 | D141A_E143A_Y261A_L409S_Y410A_P411G_W767H | ++ |
| 1301 | Y7F_D141A_D143A_Y261A_Y410L_P411T_A485L | |
| 1302 | V93Y_D141A_E143A_Y261A_L409S_Y410A_P411G_C509N_S512D_D671R | |
| 1303 | Y7F_D141A_D143A_Y261A_Y410T_A485L_T514S_G517A | |
| 1304 | D141A_E143A_Y261A_L409S_Y410A_P411G_S506T_D671R | ++ |
| 1305 | Y7F_D141A_D143A_Y261A_L409I_Y410M_A485L_T514A | |
| 1306 | D141A_E143A_Y261A_L409S_Y410A_P411G_C509A_D671R | ++ |
| 1307 | Y7F_D141A_D143A_Y261A_S408A_A485L | |
| 1308 | Y7F_D141A_D143A_Y261A_L409I_Y410F_A485L_T514S | |
| 1309 | Y7F_D141A_D143A_Y261A_S408G_A485L | |
| 1310 | V93Y_D141A_E143A_Y261A_L409S_Y410A_P411G_D671R_W767S | ++ |
| 1311 | V93Y_D141A_E143A_Y261A_L409S_Y410A_P411G_D671R_M770^ | |

FIG. 31FF

Table 3: Wild type RLF 89458.1 = SEQ ID NO:1; wild type RLF 78286 = SEQ ID NO:2

| SEQ# | Mutations based on SEQ ID NOS: 1 or 2 | Intensity |
|---|---|---|
| 1312 | Y7F_D141A_D143A_Y261A_L409I_Y410L_A485L_T514S | |
| 1313 | Y7F_D141A_D143A_Y261A_Y410T_A485L_V513F | |
| 1314 | Y7F_D141A_D143A_Y261A_A485L_Y493F | |
| 1315 | V93Y_D141A_E143A_Y261A_L409S_Y410A_P411G_S506L_D671R | |

FIG. 31GG

Table 4: Wild type NOZ 58130 = SEQ ID NO:1316

| SEQ# | Mutations based on SEQ ID NO:1316 | Incorp'n |
|---|---|---|
| 1317 | Y14F_D168A_E170A_L440Y_Y441G | ++ |
| 1318 | D168A_E170A_L440S_Y441A | + |
| 1319 | Y14F_D168A_E170A_L440Y_Y441A_P442G | + |
| 1320 | D168A_E170A_L440F_Y441A_P442G | + |
| 1321 | Y14F_D168A_E170A_L440Y_Y441A | + |
| 1322 | D168A_E170A_L440Y_Y441A_P442G | + |
| 1323 | Y14F_D168A_E170A_L440F_Y441A_P442G | + |
| 1324 | D168A_E170A_L440F_Y441G | + |
| 1325 | Y14F_D168A_E170A_L440F_Y441G | + |
| 1326 | D168A_E170A_L440Y_Y441A | + |
| 1327 | Y14F_D168A_E170A_L440S_Y441A | + |
| 1328 | Y14F_D168A_E170A_L440A_Y441A_P442A | + |
| 1329 | D168A_E170A_L440A_Y441A_P442A | + |
| 1330 | Y14N_R122S_R150A_D168A_E170A_L440F_Y441G_I480Y_R496T_R537S_E559N | ++ |
| 1331 | Y14F_D168A_E170A_K319V_L440F_Y441G | ++ |
| 1332 | Y14F_D168V_E170L_C362V_L440F_Y441G_C539V_V543S | + |
| 1333 | Y14F_D168A_E170A_K319R_C362L_L440F_Y441G | + |
| 1334 | Y14F_D168A_E170A_C362V_L440F_Y441G_C539V | + |
| 1335 | Y14F_D168V_E170L_C362V_F440H_Y441G_C539V | + |
| 1336 | Y14F_D168A_E170A_L440F_Y441G_V566S | + |
| 1337 | Y14F_D168A_E170A_C362L_Y408R_L440F_Y441G | + |
| 1338 | Y14F_D168V_E170L_C362V_Y441G_C539V_I551V | + |
| 1339 | Y14N_R122S_E157F_D168A_E170A_E331N_L440F_Y441G_R496T_R537S_E559N | ++ |

FIG. 32A

Table 4: Wild type NOZ 58130 = SEQ ID NO:1316

| SEQ# | Mutations based on SEQ ID NOS: 1316 | Incorp'n |
|---|---|---|
| 1340 | Y14D_R122S_D168A_E170A_C362L_L440F_Y441G_R496T_A515T_R537S_E559K | ++ |
| 1341 | Y14F_W135L_D168A_E170A_C362L_L440F_Y441G | + |
| 1342 | Y14N_R122S_R150A_D168A_E170A_L440F_Y441G_R537S_E559N | ++ |
| 1343 | Y14N_R122S_E157F_D168A_E170A_L440F_Y441G_R537S_E559N | ++ |
| 1344 | Y14D_R122S_D168A_E170A_V298I_L440F_Y441G_R496T_A515T_R537S_E559K | ++ |
| 1345 | Y14F_D168A_E170A_C362L_L440F_Y441G_Q785^ | + |
| 1346 | Y14F_D168A_E170A_L440F_Y441G_W791R_F792R | + |
| 1347 | Y14N_R122S_R150V_D168A_E170A_E331N_L440F_Y441G_R496T_R537S_E559K | ++ |
| 1348 | Y14N_R122S_R150A_D168V_E170V_L440F_Y441G_R496T_R537S_E559N | ++ |
| 1349 | Y14F_D168A_E170A_D330E_L440F_Y441G | + |
| 1350 | Y14F_D168V_E170L_C362V_F440I_Y441G_C539V | + |
| 1351 | Y14N_R122S_R150V_D168A_E170A_L440F_Y441G_R537S_E559K | ++ |
| 1352 | Y14F_W135R_D168A_E170A_C362L_L440F_Y441G | + |
| 1353 | Y14F_D168A_E170A_L440F_Y441G_V566R | + |
| 1354 | Y14F_D168A_E170A_C362L_L440F_Y441G_F523Y | + |
| 1355 | Y14F_D168A_E170A_L440F_Y441G_E565R | ++ |
| 1356 | Y14N_R122S_R150V_D168A_E170A_L440F_Y441G_I480Y_R496T_R537S_E559K | + |
| 1357 | Y14N_R122S_E157F_D168A_E170A_C362L_L440F_Y441G_R496T_R537S_E559N | ++ |

FIG. 32B

Table 4: Wild type NOZ 58130 = SEQ ID NO:1316

| SEQ# | Mutations based on SEQ ID NOS: 1316 | Incorp'n |
|---|---|---|
| 1358 | Y14N_R122S_R150A_D168A_E170A_L313M_L440F_Y441G_R496T_R537S_E559N | ++ |
| 1359 | Y14F_D168V_E170L_C362V_F440V_Y441G_C539V | + |
| 1360 | Y14F_V121A_D168A_E170A_L440F_Y441G | + |
| 1361 | Y14D_R122S_D168A_E170A_E331N_L440F_Y441G_R496T_A515T_R537S_E559K | ++ |
| 1362 | Y14N_R122S_R150V_D168A_E170A_L313M_L440F_Y441G_R496T_R537S_E559K | ++ |
| 1363 | Y14N_R122S_R150A_D168A_E170A_L440F_Y441G_I480F_R496T_R537S_E559N | ++ |
| 1364 | Y14F_P83R_D168A_E170A_C362L_L440F_Y441G | + |
| 1365 | Y14F_D168A_E170A_L440F_Y441G_V566K | + |
| 1366 | Y14F_D168A_E170A_G275R_L440F_Y441G | + |
| 1367 | Y14F_D168V_E170L_C362V_S439G_L440F_Y441G_C539V | 0 |
| 1368 | Y14N_R122S_E157F_D168A_E170A_V298I_L440F_Y441G_R496T_R537S_E559N | ++ |
| 1369 | Y14F_D168A_E170A_A352E_C362L_L440F_Y441G | + |
| 1370 | Y14F_D168A_E170A_L440F_Y441G_L585K | + |
| 1371 | Y14F_D168A_E170A_C362L_L440F_Y441G_M723N | + |
| 1372 | Y14F_D168V_E170L_C362V_L440F_Y441G_C539V_V543G | 0 |
| 1373 | Y14F_D168A_E170A_L440F_Y441G_E565N | + |
| 1374 | Y14F_R84K_D168A_E170A_L440F_Y441G | ++ |
| 1375 | Y14N_R122S_E157F_D168A_E170A_L313M_L440F_Y441G_R496T_R537S_E559N | ++ |
| 1376 | Y14F_D168V_E170L_C362V_S439A_L440F_Y441G_S443A_C539V | 0 |

FIG. 32C

Table 4: Wild type NOZ 58130 = SEQ ID NO:1316

| SEQ# | Mutations based on SEQ ID NOS: 1316 | Incorp'n |
|---|---|---|
| 1377 | Y14F_D168A_E170A_C362L_L440F_Y441G_W791R_F792R | + |
| 1378 | Y14F_R84N_D168A_E170A_L440F_Y441G | ++ |
| 1379 | Y14F_D168A_E170A_F326A_L440F_Y441G | + |
| 1380 | Y14F_D168A_E170A_A352D_L440F_Y441G | ++ |
| 1381 | Y14N_R122S_R150V_D168A_E170A_L440F_Y441G_I480F_R496T_R537S_E559K | ++ |
| 1382 | Y14F_D168V_E170L_C362V_L440F_Y441G_S443G_C539V | 0 |
| 1383 | Y14F_D168V_E170L_C362V_Y441G_I445F_C539V | + |
| 1384 | Y14F_D168A_E170A_C362L_L440F_Y441G_D777^ | + |
| 1385 | Y14N_R122S_E157F_D168V_E170V_L440F_Y441G_R496T_R537S_E559N | ++ |
| 1386 | Y14D_R122S_D168V_E170V_L440F_Y441G_R496T_A515T_R537S_E559K | ++ |
| 1387 | Y14F_D168A_E170A_L440F_Y441G_W791R_F792^ | + |
| 1388 | Y14F_D168A_E170A_A352E_L440F_Y441G | ++ |
| 1389 | Y14N_R122S_R150V_D168A_E170A_V298I_L440F_Y441G_R496T_R537S_E559K | ++ |
| 1390 | Y14F_D168A_E170A_L440F_Y441G_E565K | + |
| 1391 | Y14F_D168A_E170A_F326A_C362L_L440F_Y441G | + |
| 1392 | Y14F_D168V_E170L_C362V_L440F_Y441G_C539V_V543A | + |
| 1393 | Y14F_D168A_E170A_T327Q_L440F_Y441G | + |
| 1394 | Y14F_D168A_E170A_C362L_L440F_Y441G_M723^ | 0 |
| 1395 | Y14F_D168V_E170L_C362V_S439G_L440F_Y441G_S443G_C539V | 0 |

FIG. 32D

Table 4: Wild type NOZ 58130 = SEQ ID NO:1316

| SEQ# | Mutations based on SEQ ID NOS: 1316 | Incorp'n |
|---|---|---|
| 1396 | Y14F_D168A_E170A_D321F_L440F_Y441G | + |
| 1397 | Y14F_E76N_D168A_E170A_L440F_Y441G | ++ |
| 1398 | Y14N_R122S_R150V_D168V_E170V_L440F_Y441G_R496T_R537S_E559K | ++ |
| 1399 | Y14F_R84S_D168A_E170A_L440F_Y441G | + |
| 1400 | Y14F_D168A_E170A_V288F_L440F_Y441G | ++ |
| 1401 | Y14F_D168V_E170L_C362V_Y441G_F511L_C539V | + |
| 1402 | Y14F_D168V_E170L_C362V_Y441G_C539V_I551A | ++ |
| 1403 | Y14F_D168V_E170L_C362V_L440F_Y441G_C539V | + |
| 1404 | Y14F_V121A_D168A_E170A_C362L_L440F_Y441G | + |
| 1405 | Y14N_R122S_R150V_D168A_E170A_L440F_Y441G_R496T_R537S_E559K_N759P | ++ |
| 1406 | Y14F_D168A_E170A_A352Q_C362L_L440F_Y441G | + |
| 1407 | Y14F_D168A_E170A_D330N_L440F_Y441G | ++ |
| 1408 | Y14F_D168A_E170A_F326T_C362L_L440F_Y441G | + |
| 1409 | Y14F_D168A_E170A_G275K_L440F_Y441G | + |
| 1410 | Y14F_D168V_E170L_C362V_Y441G_I445L_C539V | + |
| 1411 | Y14F_D168V_E170L_C362V_Y441G_C539V_A547G | + |
| 1412 | Y14F_V85R_D168A_E170A_L440F_Y441G | + |
| 1413 | Y14N_R122S_E157F_D168A_E170A_L440F_Y441G_I480F_R496T_R537S_E559N | ++ |
| 1414 | Y14F_E76Q_D168A_E170A_L440F_Y441G | + |
| 1415 | Y14F_D168V_E170L_C362V_Y441G_Y524L_C539V | 0 |

FIG. 32E

Table 4: Wild type NOZ 58130 = SEQ ID NO:1316

| SEQ# | Mutations based on SEQ ID NOS: 1316 | Incorp'n |
|---|---|---|
| 1416 | Y14F_D168V_E170L_C362V_Y441G_C539V_I551L | + |
| 1417 | Y14F_D168V_E170L_L440F_Y441G | ++ |
| 1418 | Y14F_D168V_E170L_C362V_Y441G_F511Y_C539V | + |
| 1419 | Y14F_D168A_E170A_C362L_L440F_Y441G_W791R_F792^ | + |
| 1420 | Y14F_D168A_E170A_G275N_L440F_Y441G | + |
| 1421 | Y14N_R122S_E157F_D168A_E170A_L440F_Y441G_R496T_R537S_E559N_N759P | ++ |
| 1422 | Y14F_D168A_E170A_D321F_C362L_L440F_Y441G | + |
| 1423 | Y14F_D168V_E170L_C362V_S439A_L440F_Y441G_C539V | + |
| 1424 | Y14N_R122S_E157F_D168A_E170A_L440F_Y441G_I480Y_R496T_R537S_E559N | ++ |
| 1425 | Y14F_D168A_E170A_F326T_L440F_Y441G | + |
| 1426 | Y14F_D168A_E170A_C362L_T327Q_L440F_Y441G | + |
| 1427 | Y14F_D168V_E170L_C362V_Y441G_F511V_C539V | + |
| 1428 | Y14F_E76N_D168A_E170A_C362L_L440F_Y441G | + |
| 1429 | Y14F_D168V_E170L_C362V_Y441G_Y524F_C539V | 0 |
| 1430 | Y14F_D168V_E170L_C362V_L440F_Y441G_S443A_C539V | + |
| 1431 | Y14D_R122S_D168A_E170A_L313M_L440F_Y441G_R496T_A515T_R537S_E559K | 0 |
| 1432 | Y14N_R122S_R150A_D168A_E170A_C362L_L440F_Y441G_R496T_R537S_E559N | ++ |
| 1433 | Y14F_W135S_D168A_E170A_C362L_L440F_Y441G | + |
| 1434 | Y14F_D168A_E170A_F326N_C362L_L440F_Y441G | + |

FIG. 32F

Table 4: Wild type NOZ 58130 = SEQ ID NO:1316

| SEQ# | Mutations based on SEQ ID NOS: 1316 | Incorp'n |
|---|---|---|
| 1435 | Y14F_D168A_E170A_P292R_L440F_Y441G | + |
| 1436 | Y14F_D168A_E170A_K319R_L440F_Y441G | + |
| 1437 | Y14F_D168V_E170L_C362V_Y441G_I444V_C539V | + |
| 1438 | Y14F_P83R_D168A_E170A_L440F_Y441G | ++ |
| 1439 | Y14F_D168A_E170A_L290I_C362L_L440F_Y441G | + |
| 1440 | Y14F_D168A_E170A_C362L_L440F_Y441G_R790^ | + |
| 1441 | Y14N_R122S_R150A_D168A_E170A_V298I_L440F_Y441G_R496T_R537S_E559N | ++ |
| 1442 | Y14N_R122S_R150A_D168A_E170A_L440F_Y441G_R496T_R537S_E559N_N759P | ++ |
| 1443 | Y14F_V85R_D168A_E170A_C362L_L440F_Y441G | + |
| 1444 | Y14F_D168A_E170A_L440F_Y441G_M723^ | 0 |
| 1445 | Y14F_D168A_E170A_C362L_L440F_Y441G_G773^ | + |
| 1446 | Y14F_D168A_E170A_C362L_L440F_Y441G_M723T | + |
| 1447 | Y14N_R122S_R150A_D168A_E170A_E331N_L440F_Y441G_R496T_R537S_E559N | ++ |

FIG. 32G

Table 5: Wild type NOZ 58130 = SEQ ID NO:1316

| SEQ# | Mutations based on SEQ ID NOS: 1316 | Intensity |
|---|---|---|
| 1448 | Y14F_D168A_E170A_L440F_Y441G_G782^ | ++ |
| 1449 | Y14F_D168A_E170A_L440F_Y441G_G782^ | ++ |
| 1450 | D168A_E170A_G782^ | ++ |

FIG. 33

Table 6: Wild type NOZ 58130 = SEQ ID NO:1316

| SEQ# | Mutations based on SEQ ID NO:1316 | Incorp'n |
|---|---|---|
| 1451 | Y14F_D168A_E170A_E406R_L440F_Y441G | + |
| 1452 | Y14N_R122S_D168A_E170A_L440F_Y441G_R496T_E559N | |
| 1453 | Y14D_R122S_D168A_E170A_L440F_Y441G_I480F_R496T_A515T_R537S_E559N | |
| 1454 | Y14D_R122S_D168A_E170A_L440F_Y441G_A515T_E559N | + |
| 1455 | Y14I_D168A_E170A_L440F_Y441G_E559N | |
| 1456 | Y14D_R150V_D168A_E170A_L440F_Y441G_R496T_R537S_E559N | |
| 1457 | Y14N_R122S_R150V_D168A_E170A_L440F_Y441G_R496T_R537S_E559N | |
| 1458 | Y14N_E157F_D168A_E170A_L440F_Y441G_R496T_E559K | + |
| 1459 | Y14F_R122S_D168A_E170A_L440F_Y441G_E559N | |
| 1460 | Y14D_D168A_E170A_L440F_Y441G_I480F_R496T_A515T_R537S_E559N | + |
| 1461 | Y14F_E153R_D168A_E170A_L440F_Y441G | |
| 1462 | Y14F_R150K_D168A_E170A_L440F_Y441G | |
| 1463 | Y14N_R122S_D168A_E170A_L440F_Y441G_R496T_R537S_E559K_N759P | |
| 1464 | Y14D_D168A_E170A_L440F_Y441G_I480Y_R537S_E559N | |
| 1465 | Y14F_D168A_E170A_L440F_Y441G_A515V_S522N | ++ |
| 1466 | Y14D_R122S_D168A_E170A_E331N_L440F_Y441G_R496T_A515T_R537S_E559N | |
| 1467 | Y14D_E157F_D168A_E170A_L440F_Y441G_R496T_A515T_R537S_E559N | |
| 1468 | Y14F_D168A_E170A_L440S_Y441A_P442G_A515L | + |
| 1469 | Y14F_R150L_D168A_E170A_L440F_Y441G | |

FIG. 34A

Table 6: Wild type NOZ 58130 = SEQ ID NO:1316

| SEQ# | Mutations based on SEQ ID NO:1316 | Incorp'n |
|---|---|---|
| 1470 | Y14N_R150V_D168A_E170A_L440F_Y441G_R496T_E559K | + |
| 1471 | Y14N_R122S_D168A_E170A_L440F_Y441G_R496T_R537S_E559K | ++ |
| 1472 | Y14F_R122D_D168A_E170A_L440F_Y441G_A515T | + |
| 1473 | Y14D_E153K_D168A_E170A_L440F_Y441G_R496T_E559K | 0 |
| 1474 | Y14N_R122S_D168A_E170A_C362L_L440F_Y441G_R496T_A515T_R537S_E559N | |
| 1475 | Y14N_D168A_E170A_L313M_L440F_Y441G_E559K | |
| 1476 | Y14D_R122S_E156N_D168A_E170A_L440F_Y441G_R496T_R537S_E559N | + |
| 1477 | Y14D_R122S_D168A_E170A_E331N_L440F_Y441G_R496T_R537S_E559N | |
| 1478 | Y14D_D168A_E170A_L440F_Y441G_I480Y_E559K | |
| 1479 | Y14F_D168A_E170A_L440S_Y441A_P442G_A515S | |
| 1480 | Y14F_D168A_E170A_A515L | + |
| 1481 | Y14D_R122S_D168A_E170A_L440F_Y441G_R496T_E559N | + |
| 1482 | Y14D_R122S_R150V_D168A_E170A_L440F_Y441G_R496T_E559N | |
| 1483 | Y14F_D168A_E170A_L440F_Y441G_A515T_F523V | |
| 1484 | Y14N_D168A_E170A_L440F_Y441G_R496T_R537S_E559N_N759P | |
| 1485 | Y14F_D168A_E170A_L440F_Y441G_A515T_R537G | |
| 1486 | Y14N_D168A_E170A_C362L_L440F_Y441G_R496T_R537S_E559K | ++ |
| 1487 | Y14D_D168A_E170A_E331N_L440F_Y441G_R496T_A515T_R537S_E559N | |

FIG. 34B

Table 6: Wild type NOZ 58130 = SEQ ID NO:1316

| SEQ# | Mutations based on SEQ ID NO:1316 | Incorp'n |
|---|---|---|
| 1488 | Y14N_R122S_D168A_E170A_L440F_Y441G_R496T_R537S_E559N_N759P | + |
| 1489 | Y14D_R122S_D168V_E170V_L440F_Y441G_R496T_A515T_R537S_E559N | |
| 1490 | Y14N_R122S_D168A_E170A_L440F_Y441G_I480F_R496T_A515T_R537S_E559N | |
| 1491 | Y14D_R122S_R150V_D168A_E170A_L440F_Y441G_R496T_R537S_E559K | |
| 1492 | Y14N_R122S_D168V_E170V_L440F_Y441G_R496T_E559K | 0 |
| 1493 | Y14F_D168A_E170A_L440A_Y441A_P442A | |
| 1494 | Y14N_D168A_E170A_L440F_Y441G_I480Y_E559K | + |
| 1495 | Y14N_D168A_E170A_L440F_Y441G_R496T_A515T_R537S_E559N | + |
| 1496 | Y14D_R150V_D168A_E170A_L440F_Y441G_R496T_R537S_E559K | + |
| 1497 | Y14N_D168V_E170V_L440F_Y441G_E559K | + |
| 1498 | Y14D_R122S_D168A_E170A_L440F_Y441G_E559N | |
| 1499 | Y14F_D168A_E170A_L440F_Y441G_S698R | |
| 1500 | Y14D_R122S_D168A_E170A_L313M_L440F_Y441G_R496T_A515T_R537S_E559N | + |
| 1501 | Y14N_D168A_E170A_L440F_Y441G_E559N | + |
| 1502 | Y14F_D168A_E170A_L440F_Y441G_A515S | |
| 1503 | Y14N_R150A_D168A_E170A_L440F_Y441G_R496T_E559K | |
| 1504 | Y14N_R122S_R150A_D168A_E170A_L440F_Y441G_R496T_A515T_R537S_E559K | ++ |
| 1505 | Y14F_D168A_E170A_L440F_Y441G_I480Y | |
| 1506 | Y14N_D168A_E170A_L440F_Y441G_I480F_E559K | |

FIG. 34C

Table 6: Wild type NOZ 58130 = SEQ ID NO:1316

| SEQ# | Mutations based on SEQ ID NO:1316 | Incorp'n |
|---|---|---|
| 1507 | Y14N_D168A_E170A_V298I_L440F_Y441G_R496T_A515T_R537S_E559N | + |
| 1508 | Y14F_D168A_E170A_L440F_Y441G | |
| 1509 | Y14N_D168A_E170A_L440F_Y441G_R496T_E559N_N759P | 0 |
| 1510 | Y14F_D168A_E170A_L440F_Y441G_F523S | |
| 1511 | Y14D_E157F_D168A_E170A_L440F_Y441G_R496T_E559N | + |
| 1512 | Y14N_D168A_E170A_L440F_Y441G_E559K | |
| 1513 | Y14F_D168A_E170A_L440F_Y441G_A515V_F523I | |
| 1514 | Y14D_R122S_D168A_E170A_L440F_Y441G_A515T_R537S_E559K | |
| 1515 | Y14F_V97A_D168A_E170A_L440F_Y441G | |
| 1516 | Y14N_R122S_D168A_E170A_L440F_Y441G_I480F_R496T_E559K | |
| 1517 | Y14D_D168A_E170A_L440F_Y441G_I480F_E559K | |
| 1518 | Y14N_R122S_R150V_D168A_E170A_L440F_Y441G_R496T_E559N | |
| 1519 | Y14N_R150A_D168A_E170A_L440F_Y441G_R496T_E559N | + |
| 1520 | Y14N_R122S_D168A_E170A_L440F_Y441G_E559N | |
| 1521 | Y14D_R122S_D168A_E170A_V298I_L440F_Y441G_R496T_A515T_R537S_E559N | + |
| 1522 | Y14N_D168A_E170A_L440F_Y441G_R496T_R537S_E559N | |
| 1523 | D168A_E170A_L440S_Y441A_P442G | + |
| 1524 | Y14N_R122S_D168A_E170A_E331N_L440F_Y441G_R496T_E559N | |

FIG. 34D

Table 6: Wild type NOZ 58130 = SEQ ID NO:1316

| SEQ# | Mutations based on SEQ ID NO:1316 | Incorp'n |
|---|---|---|
| 1525 | Y14D_R122S_D168A_E170A_C362L_L440F_Y441G_R496T_E559K | + |
| 1526 | Y14F_D168F_E170A_L440F_Y441G | + |
| 1527 | Y14F_E153F_D168A_E170A_L440F_Y441G | |
| 1528 | D168A_E170A_L440S_Y441A | + |
| 1529 | Y14F_D168A_E170A_C362V_L440F_Y441G | |
| 1530 | Y14N_R122S_D168A_E170A_L440F_Y441G_R496T_A515T_R537S_E559N_N759P | |
| 1531 | Y14D_E156N_D168A_E170A_L440F_Y441G_E559K | |
| 1532 | Y14D_E157F_D168A_E170A_L440F_Y441G_R496T_R537S_E559N | |
| 1533 | Y14D_R122S_D168A_E170A_L440F_Y441G_A515T_E559K | |
| 1534 | Y14N_R122S_E157F_D168A_E170A_L440F_Y441G_R496T_A515T_R537S_E559K | |
| 1535 | Y14D_D168V_E170V_L440F_Y441G_E559K | |
| 1536 | Y14D_R122S_R150V_D168A_E170A_L440F_Y441G_R496T_A515T_R537S_E559K | |
| 1537 | Y14D_D168A_E170A_V298I_L440F_Y441G_E559K | + |
| 1538 | Y14F_D168A_E170A_E331N_L440F_Y441G | |
| 1539 | Y14D_R122S_R150A_D168A_E170A_L440F_Y441G_R496T_R537S_E559K | + |
| 1540 | Y14D_D168A_E170A_L313M_L440F_Y441G_E559K | 0 |
| 1541 | D168A_E170A | + |
| 1542 | Y14F_D168A_E170A_L440F_Y441G_A515T | |
| 1543 | Y14N_D168A_E170A_V298I_L440F_Y441G_R496T_E559K | |
| 1544 | Y14F_D168A_E170A_L440S_Y441A_P442G_A515T | |

FIG. 34E

Table 6: Wild type NOZ 58130 = SEQ ID NO:1316

| SEQ# | Mutations based on SEQ ID NO:1316 | Incorp'n |
|---|---|---|
| 1545 | Y14N_R122S_D168A_E170A_L440F_Y441G_A515T_R537S_E559K | + |
| 1546 | Y14N_D168A_E170A_L313M_L440F_Y441G_R496T_R537S_E559N | + |
| 1547 | Y14N_D168A_E170A_E331N_L440F_Y441G_R496T_R537S_E559N | |
| 1548 | Y14F_R122S_D168A_E170A_L440F_Y441G_R496T_E559K | + |
| 1549 | Y14F_D168A_E170A_L440Y_Y441A_A515L | |
| 1550 | Y14N_R122S_D168A_E170A_V298I_L440F_Y441G_R496T_E559K | |
| 1551 | Y14D_R122S_D168A_E170A_L440F_Y441G_I480F_R496T_E559N | |
| 1552 | Y14F_E157R_D168A_E170A_L440F_Y441G | |
| 1553 | Y14N_R122S_E157F_D168A_E170A_L440F_Y441G_R496T_R537S_E559N | |
| 1554 | Y14D_D168A_E170A_V298I_L440F_Y441G_R496T_R537S_E559K | + |
| 1555 | Y14D_D168V_E170V_L440F_Y441G_R496T_E559K | + |
| 1556 | Y14F_D168A_E170A_L440F_Y441T_P442A_E559N | 0 |
| 1557 | Y14F_D168A_E170A_L440F_Y441G_P442A_A515V | |
| 1558 | Y14D_R122S_D168A_E170A_L440F_Y441G_R496T_E559N_N759P | |
| 1559 | Y14D_D168A_E170A_L440F_Y441G_I480Y_R496T_R537S_E559K | + |
| 1560 | Y14F_D168A_E170A_L440Y_Y441G_A515S | |
| 1561 | Y14D_R150A_D168A_E170A_L440F_Y441G_R496T_A515T_R537S_E559N | + |
| 1562 | Y14D_R122S_D168A_E170A_E331N_L440F_Y441G_R496T_E559K | + |

FIG. 34F

Table 6: Wild type NOZ 58130 = SEQ ID NO:1316

| SEQ# | Mutations based on SEQ ID NO:1316 | Incorp'n |
|---|---|---|
| 1563 | Y14D_R122S_R150V_D168A_E170A_L440F_Y441G_R496T_E559K | ++ |
| 1564 | Y14F_D168A_E170F_L440F_Y441G | + |
| 1565 | Y14N_R122S_D168A_E170A_L313M_L440F_Y441G_R496T_E559N | |
| 1566 | Y14F_D168A_E170A_A515V | |
| 1567 | Y14D_R122S_D168A_E170A_V298I_L440F_Y441G_R496T_R537S_E559N | + |
| 1568 | Y14N_D168A_E170A_L440F_Y441G_R496T_R537S_E559K | |
| 1569 | Y14N_R122S_D168A_E170A_L440F_Y441G_I480F_R496T_R537S_E559K | + |
| 1570 | Y14D_D168A_E170A_L313M_L440F_Y441G_R537S_E559N | + |
| 1571 | Y14F_D168A_E170A_L440F_Y441A_P442G_A515S | |
| 1572 | Y14D_R122S_D168A_E170A_L440F_Y441G_I480F_R496T_R537S_E559K | |
| 1573 | Y14D_D168A_E170A_L440F_Y441G_R537S_E559N_N759P | |
| 1574 | Y14F_D168A_E170A_L440F_Y441G_A515T_F523T | + |
| 1575 | Y14F_D168A_E170A_L440Y_Y441A_A515V | |
| 1576 | Y14N_R150A_D168A_E170A_L440F_Y441G_R496T_R537S_E559N | |
| 1577 | Y14F_D168V_E170A_L440F_Y441G | |
| 1578 | Y14N_R122S_D168A_E170A_L313M_L440F_Y441G_R496T_A515T_R537S_E559N | + |
| 1579 | Y14F_D168A_E170A_L440F_Y441G_S522T | + |
| 1580 | Y14F_D168A_E170A_V384Y_L440F_Y441G | |

FIG. 34G

Table 6: Wild type NOZ 58130 = SEQ ID NO:1316

| SEQ# | Mutations based on SEQ ID NO:1316 | Incorp'n |
|---|---|---|
| 1581 | Y14D_D168A_E170A_L440F_Y441G_I480F_R496T_E559N | |
| 1582 | Y14N_R122S_D168A_E170A_L440F_Y441G_R496T_E559K_N759P | ++ |
| 1583 | Y14F_D168A_E170V_L440F_Y441G | |
| 1584 | Y14N_D168A_E170A_L440F_Y441G_I480F_R496T_E559N | |
| 1585 | Y14D_D168A_E170A_L440F_Y441G_R496T_E559K_N759P | 0 |
| 1586 | Y14F_D168A_E170A | |
| 1587 | Y14D_E156N_D168A_E170A_L440F_Y441G_R496T_A515T_R537S_E559N | + |
| 1588 | Y14D_D168A_E170A_E331N_L440F_Y441G_R496T_E559N | ++ |
| 1589 | Y14F_R122N_D168A_E170A_L440F_Y441G_A515T | |
| 1590 | Y14N_R122S_R150A_D168A_E170A_L440F_Y441G_R496T_E559K | + |
| 1591 | Y14F_D168A_E170I_L440F_Y441G | |
| 1592 | Y14N_R122S_E157F_D168A_E170A_L440F_Y441G_R496T_E559N | + |
| 1593 | Y14D_D168A_E170A_L440F_Y441G_R496T_E559N | |
| 1594 | Y14D_D168A_E170A_L440F_Y441G_I480F_R496T_R537S_E559K | |
| 1595 | Y14N_R122S_R150V_D168A_E170A_L440F_Y441G_R496T_E559K | + |
| 1596 | Y14N_R122S_R150V_D168A_E170A_L440F_Y441G_R496T_E559K | + |
| 1597 | Y14N_E153K_D168A_E170A_L440F_Y441G_R496T_E559K | + |
| 1598 | Y14N_R122S_D168A_E170A_E331N_L440F_Y441G_R496T_R537S_E559N | + |

FIG. 34H

Table 6: Wild type NOZ 58130 = SEQ ID NO:1316

| SEQ# | Mutations based on SEQ ID NO:1316 | Incorp'n |
|---|---|---|
| 1599 | Y14F_D168A_E170A_L440F_Y441G_A515V | + |
| 1600 | Y14F_D168A_E170A_L440S_Y441A_A515V | + |
| 1601 | Y14F_D168I_E170A_L440F_Y441G | + |
| 1602 | Y14F_D168A_E170A_L440Y_Y441A_P442G_A515S | |
| 1603 | Y14D_R150A_D168A_E170A_L440F_Y441G_R496T_R537S_E559K | |
| 1604 | Y14D_R122S_D168A_E170A_L313M_L440F_Y441G_R496T_R537S_E559K | + |
| 1605 | Y14F_E157A_D168A_E170A_L440F_Y441G | ++ |
| 1606 | Y14D_D168A_E170A_E331N_L440F_Y441G_R537S_E559N | 0 |
| 1607 | Y14F_D168A_E170A_L440Y_Y441G_P442A | + |
| 1608 | Y14F_D168A_E170A_L440Y_Y441A_P442G_A515V | 0 |
| 1609 | Y14D_R122S_D168A_E170A_L440F_Y441G_E559K | |
| 1610 | Y14N_R122S_D168A_E170A_L440F_Y441G_I480F_R496T_E559N | + |
| 1611 | Y14N_D168A_E170A_L440F_Y441G_A515T | |
| 1612 | Y14D_R150A_D168A_E170A_L440F_Y441G_R496T_E559N | |
| 1613 | Y14N_R150V_D168A_E170A_L440F_Y441G_R496T_R537S_E559N | |
| 1614 | Y14D_R122S_D168A_E170A_V298I_L440F_Y441G_R496T_E559N | |
| 1615 | Y14N_E156N_D168A_E170A_L440F_Y441G_R496T_E559N | + |
| 1616 | Y14F_R150F_D168A_E170A_L440F_Y441G | |
| 1617 | Y14D_R150A_D168A_E170A_L440F_Y441G_R496T_R537S_E559N | |
| 1618 | Y14N_D168V_E170V_L440F_Y441G_R496T_A515T_R537S_E559N | |

FIG. 34I

Table 6: Wild type NOZ 58130 = SEQ ID NO:1316

| SEQ# | Mutations based on SEQ ID NO:1316 | Incorp'n |
|---|---|---|
| 1619 | Y14F_D168A_E170A_L440F_Y441G_A515V_F523S | + |
| 1620 | Y14F_E153V_D168A_E170A_L440F_Y441G | |
| 1621 | Y14D_E156N_D168A_E170A_L440F_Y441G_R496T_R537S_E559K | |
| 1622 | Y14N_R150V_D168A_E170A_L440F_Y441G_R496T_R537S_E559N | |
| 1623 | Y14F_D168A_E170A_L440S_Y441A_P442G | |
| 1624 | Y14N_R150A_D168A_E170A_L440F_Y441G_R496T_R537S_E559N | + |
| 1625 | Y14D_D168A_E170A_L440F_Y441G_E559N | |
| 1626 | D168A_E170A_L440S_Y441A_P442G | + |
| 1627 | Y14N_R122S_D168A_E170A_E331N_L440F_Y441G_R496T_E559K | |
| 1628 | Y14N_D168A_E170A_L440F_Y441G_I480F_R496T_A515T_R537S_E559N | |
| 1629 | Y14N_E157F_D168A_E170A_L440F_Y441G_R496T_R537S_E559K | + |
| 1630 | Y14N_D168A_E170A_L440F_Y441G_R496T_E559K | |
| 1631 | Y14N_R122S_R150A_D168A_E170A_L440F_Y441G_R496T_E559N | + |
| 1632 | Y14D_D168A_E170A_L440F_Y441G_A515T | |
| 1633 | Y14D_R122S_E156N_D168A_E170A_L440F_Y441G_R496T_E559K | 0 |
| 1634 | Y14F_D168A_E170A_L440F_Y441A_P442G | |
| 1635 | Y14F_R122S_D168A_E170A_L440F_Y441G_R496T_A515T_R537S_E559N | |
| 1636 | Y14D_E156N_D168A_E170A_L440F_Y441G_R537S_E559N | + |
| 1637 | Y14F_D168A_E170A_L440F_Y441G_Q691Y | |
| 1638 | Y14F_D168A_E170A_L440Y_Y441G_A515L | |

FIG. 34J

Table 6: Wild type NOZ 58130 = SEQ ID NO:1316

| SEQ# | Mutations based on SEQ ID NO:1316 | Incorp'n |
|---|---|---|
| 1639 | Y14D_R122S_D168V_E170V_L440F_Y441G_R496T_E559K | |
| 1640 | Y14D_R122S_D168A_E170A_L440F_Y441G_I480Y_R496T_A515T_R537S_E559N | + |
| 1641 | Y14F_D168A_E170A_L440S_Y441A_A515L | 0 |
| 1642 | Y14N_R122S_D168V_E170V_L440F_Y441G_R496T_A515T_R537S_E559N | + |
| 1643 | Y14F_D168A_E170L_L440F_Y441G | |
| 1644 | Y14N_R122S_D168A_E170A_L440F_Y441G_I480Y_R496T_R537S_E559K | + |
| 1645 | Y14D_D168A_E170A_L440F_Y441G_R537S_E559K | |
| 1646 | Y14D_D168A_E170A_L440F_Y441G_E559K_N759P | |
| 1647 | Y14N_R122S_E157F_D168A_E170A_L440F_Y441G_R496T_R537S_E559N | |
| 1648 | Y14D_R150A_D168A_E170A_L440F_Y441G_R496T_A515T_R537S_E559K | + |
| 1649 | Y14D_D168A_E170A_L313M_L440F_Y441G_R496T_R537S_E559N | |
| 1650 | Y14F_D168A_E170A_H297S_V298F_L440F_Y441G | + |
| 1651 | Y14F_D168A_E170A_L440F_Y441G_E559N | + |
| 1652 | Y14N_R122S_E153K_D168A_E170A_L440F_Y441G_R496T_R537S_E559N | |
| 1653 | Y14N_D168A_E170A_L440F_Y441G_I480Y_R496T_A515T_R537S_E559N | + |
| 1654 | Y14F_D168A_E170A_L440F_Y441G_R537K | |
| 1655 | Y14D_R150A_D168A_E170A_L440F_Y441G_R496T_E559N | |
| 1656 | Y14N_E157F_D168A_E170A_L440F_Y441G_R496T_E559N | + |
| 1657 | Y14D_D168A_E170A_L440F_Y441G_R496T_R537S_E559N | + |

FIG. 34K

Table 6: Wild type NOZ 58130 = SEQ ID NO:1316

| SEQ# | Mutations based on SEQ ID NO:1316 | Incorp'n |
|---|---|---|
| 1658 | Y14F_D168A_E170A_L440Y_Y441G | + |
| 1659 | Y14D_D168A_E170A_E331N_L440F_Y441G_E559K | |
| 1660 | Y14N_R122S_D168A_E170A_L440F_Y441G_R496T_A515T_E559K | |
| 1661 | Y14N_D168A_E170A_L440F_Y441G_I480Y_R496T_E559K | + |
| 1662 | Y14D_R122S_D168A_E170A_L440F_Y441G_R496T_R537S_E559N | |
| 1663 | Y14D_R150V_D168A_E170A_L440F_Y441G_R496T_A515T_R537S_E559K | ++ |
| 1664 | Y14D_D168A_E170A_V298I_L440F_Y441G_R496T_A515T_R537S_E559N | + |
| 1665 | Y14N_R122S_D168A_E170A_L440F_Y441G_E559K | + |
| 1666 | Y14N_D168A_E170A_L440F_Y441G_R496T_A515T_R537S_E559K | + |
| 1667 | Y14F_D168A_E170A_L440F_Y441G_Q691T | |
| 1668 | Y14N_R150V_D168A_E170A_L440F_Y441G_R496T_E559N | |
| 1669 | Y14N_D168A_E170A_V298I_L440F_Y441G_R496T_R537S_E559K | + |
| 1670 | Y14N_D168A_E170A_E331N_L440F_Y441G_R496T_R537S_E559K | |
| 1671 | Y14D_D168A_E170A_L313M_L440F_Y441G_R496T_E559K | + |
| 1672 | Y14D_R122S_R150A_D168A_E170A_L440F_Y441G_R496T_E559N | + |
| 1673 | Y14D_D168A_E170A_L440F_Y441G_E559K | + |
| 1674 | Y14F_D168A_E170A_E331R_L440F_Y441G | |
| 1675 | Y14D_D168A_E170A_L440F_Y441G_I480Y_R496T_R537S_E559N | + |
| 1676 | Y14N_D168A_E170A_E331N_L440F_Y441G_R496T_E559N | + |

FIG. 34L

Table 6: Wild type NOZ 58130 = SEQ ID NO:1316

| SEQ# | Mutations based on SEQ ID NO:1316 | Incorp'n |
|------|-----------------------------------|----------|
| 1677 | Y14D_R122S_D168A_E170A_E331N_L440F_Y441G_R496T_R537S_E559K | + |
| 1678 | Y14F_D168A_E170A_V298I_L440F_Y441G | + |
| 1679 | Y14D_R122S_D168A_E170A_L440F_Y441G_R537S_E559N | |
| 1680 | Y14D_D168A_E170A_V298I_L440F_Y441G_R496T_E559K | + |
| 1681 | Y14F_D168A_E170A_L440F_Y441G_R496T_A515T | |
| 1682 | Y14D_R122S_D168A_E170A_L440F_Y441G_I480Y_R496T_R537S_E559K | + |
| 1683 | Y14F_D168A_E170A_L440F_Y441G_D671N | + |
| 1684 | Y14D_D168A_E170A_L440F_Y441G_R496T_R537S_E559K | + |
| 1685 | Y14F_E157V_D168A_E170A_L440F_Y441G | |
| 1686 | Y14N_E156N_D168A_E170A_L440F_Y441G_R537S_E559N | + |
| 1687 | Y14D_R122S_D168A_E170A_L440F_Y441G_R496T_A515T_R537S_E559N | |
| 1688 | Y14N_R122S_D168A_E170A_L440F_Y441G_A515T_E559K | + |
| 1689 | Y14N_R122S_D168A_E170A_L440F_Y441G_R537S_E559K | |
| 1690 | Y14N_R122S_E156N_D168A_E170A_L440F_Y441G_R496T_E559K | + |
| 1691 | Y14N_R122S_E157F_D168A_E170A_L440F_Y441G_R496T_R537S_E559K | + |
| 1692 | Y14N_R122S_R150V_D168A_E170A_L440F_Y441G_R496T_R537S_E559K | |
| 1693 | Y14N_R150V_D168A_E170A_L440F_Y441G_R496T_E559N | |
| 1694 | Y14D_R122S_D168A_E170A_L440F_Y441G_R496T_R537S_E559K_N759P | |
| 1695 | D168A_E170A_L440F_Y441G | + |

FIG. 34M

Table 6: Wild type NOZ 58130 = SEQ ID NO:1316

| SEQ# | Mutations based on SEQ ID NO:1316 | Incorp'n |
|---|---|---|
| 1696 | Y14N_D168A_E170A_C362L_L440F_Y441G_E559K | ++ |
| 1697 | Y14N_D168A_E170A_C362L_L440F_Y441G_R537S_E559N | ++ |
| 1698 | Y14F_D168A_E170A_L440F_Y441G_R537S_E559N | |
| 1699 | Y14D_R122S_E156N_D168A_E170A_L440F_Y441G_R496T_R537S_E559K | + |
| 1700 | Y14F_D168A_E170A_L440A_Y441A_P442A_A515V | + |
| 1701 | Y14N_D168A_E170A_C362L_L440F_Y441G_R496T_R537S_E559N | ++ |
| 1702 | Y14F_D168A_E170A_L440F_Y441G_I480F | + |
| 1703 | Y14F_D168A_E170A_L440S_Y441A_A515T | + |
| 1704 | Y14F_D168A_E170A_L440F_Y441G_C539L | + |
| 1705 | Y14D_R122S_E153K_D168A_E170A_L440F_Y441G_R496T_E559N | ++ |
| 1706 | Y14F_D168A_E170A_L440F_Y441G_A515L | + |
| 1707 | Y14N_R122S_D168A_E170A_L313M_L440F_Y441G_R496T_R537S_E559N | |
| 1708 | Y14D_R122S_D168A_E170A_C362L_L440F_Y441G_R496T_A515T_R537S_E559N | |
| 1709 | Y14D_R122S_E153K_D168A_E170A_L440F_Y441G_R496T_A515T_R537S_E559N | |
| 1710 | Y14N_D168A_E170A_V298I_L440F_Y441G_E559K | + |
| 1711 | Y14F_D168A_E170A_L440F_Y441G_A515T | ++ |
| 1712 | Y14F_D168A_E170A_L440F_Y441G_N759P | |
| 1713 | Y14F_D168A_E170A_L440S_Y441A_P442G_A515V | + |
| 1714 | Y14F_D168A_E170A_L440F_Y441G_R496T | + |

FIG. 34N

Table 6: Wild type NOZ 58130 = SEQ ID NO:1316

| SEQ# | Mutations based on SEQ ID NO:1316 | Incorp'n |
|---|---|---|
| 1715 | Y14F_D168A_E170A_L440F_Y441A_P442G_A515T | + |
| 1716 | Y14F_D168A_E170A_L313M_L440F_Y441G | |
| 1717 | Y14N_R122S_E157F_D168A_E170A_L440F_Y441G_R496T_E559N | |
| 1718 | Y14N_D168A_E170A_L440F_Y441G_I480F_R496T_R537S_E559N | + |
| 1719 | Y14N_R122S_D168V_E170V_L440F_Y441G_R496T_R537S_E559K | ++ |
| 1720 | Y14N_D168A_E170A_L313M_L440F_Y441G_R496T_A515T_R537S_E559N | |
| 1721 | Y14D_D168A_E170A_C362L_L440F_Y441G_R496T_R537S_E559K | + |
| 1722 | Y14D_D168V_E170V_L440F_Y441G_R496T_A515T_R537S_E559N | |
| 1723 | Y14D_E153K_D168A_E170A_L440F_Y441G_R496T_R537S_E559K | |
| 1724 | D168A_E170A_A515L | |
| 1725 | Y14N_R150V_D168A_E170A_L440F_Y441G_R496T_R537S_E559K | |
| 1726 | Y14F_D168A_E170A_A515T | |
| 1727 | Y14N_D168A_E170A_L440F_Y441G_I480F_R496T_E559K | 0 |
| 1728 | Y14F_D168A_E170A_L440F_Y441G_A515V_E559N | |
| 1729 | Y14N_D168A_E170A_L440F_Y441G_I480Y_R496T_E559N | ++ |
| 1730 | Y14N_D168A_E170A_E331N_L440F_Y441G_R496T_A515T_R537S_E559N | |
| 1731 | Y14N_E156N_D168A_E170A_L440F_Y441G_E559K | ++ |
| 1732 | Y14D_D168A_E170A_C362L_L440F_Y441G_R537S_E559N | |
| 1733 | Y14D_D168A_E170A_L440F_Y441G_R496T_A515T_R537S_E559N_N759P | 0 |

FIG. 34O

Table 6: Wild type NOZ 58130 = SEQ ID NO:1316

| SEQ# | Mutations based on SEQ ID NO:1316 | Incorp'n |
|---|---|---|
| 1734 | Y14F_D168A_E170A_L440F_Y441G_S443R_E559K | + |
| 1735 | Y14F_D168A_E170A_L440Y_Y441G_A515V | + |
| 1736 | Y14D_D168A_E170A_C362L_L440F_Y441G_R496T_R537S_E559N | |
| 1737 | Y14N_D168A_E170A_L440F_Y441G_R496T_R537S_E559K_N759P | 0 |
| 1738 | Y14N_D168A_E170A_E331N_L440F_Y441G_R496T_E559K | |
| 1739 | Y14N_R122S_E153K_D168A_E170A_L440F_Y441G_R496T_A515T_R537S_E559K | + |
| 1740 | Y14D_D168A_E170A_V298I_L440F_Y441G_R496T_R537S_E559N | |
| 1741 | Y14D_R122S_E156N_D168A_E170A_L440F_Y441G_R496T_E559N | + |
| 1742 | Y14F_D168A_E170A_L440F_Y441G_C539V | + |
| 1743 | Y14N_R122S_D168A_E170A_E331N_L440F_Y441G_R496T_R537S_E559K | |
| 1744 | Y14D_R122S_D168A_E170A_C362L_L440F_Y441G_R496T_E559N | + |
| 1745 | Y14N_R122S_D168A_E170A_V298I_L440F_Y441G_R496T_R537S_E559N | 0 |
| 1746 | Y14F_D168A_E170A_L440Y_Y441A_P442G_A515L | |
| 1747 | Y14N_E157F_D168A_E170A_L440F_Y441G_R496T_R537S_E559K | |
| 1748 | Y14N_R122S_D168A_E170A_L440F_Y441G_I480Y_R496T_R537S_E559N | + |
| 1749 | Y14D_R122S_D168A_E170A_L313M_L440F_Y441G_R496T_R537S_E559N | |
| 1750 | Y14N_R122S_D168A_E170A_L440F_Y441G_R496T_A515T_E559N | |
| 1751 | Y14N_D168A_E170A_L440F_Y441G_R496T_E559K_N759P | |

FIG. 34P

Table 6: Wild type NOZ 58130 = SEQ ID NO:1316

| SEQ# | Mutations based on SEQ ID NO:1316 | Incorp'n |
|---|---|---|
| 1752 | D168A_E170A_L440S_Y441A_P442G_A515L | |
| 1753 | Y14D_D168A_E170A_L440F_Y441G_I480Y_R496T_A515T_R537S_E559N | |
| 1754 | Y14F_D168A_E170A_L440F_Y441G_A515T_S522K | + |
| 1755 | Y14F_D168A_E170A_L440F_Y441A_P442G_A515L | + |
| 1756 | Y14D_D168A_E170A_L440F_Y441G_A515V | + |
| 1757 | Y14F_R150A_D168A_E170A_L440F_Y441G | |
| 1758 | Y14D_R122S_R150A_D168A_E170A_L440F_Y441G_R496T_A515T_R537S_E559K | |
| 1759 | D168A_E170A_L440Y_Y441G | |
| 1760 | Y14N_R122S_E156N_D168A_E170A_L440F_Y441G_R496T_R537S_E559N | |
| 1761 | Y14N_R150V_D168A_E170A_L440F_Y441G_R496T_E559K | + |
| 1762 | Y14F_D168A_E170A_L440A_Y441A_P442A_A515T | |
| 1763 | Y14D_D168A_E170A_L313M_L440F_Y441G_R496T_E559N | |
| 1764 | Y14F_R122S_D168A_E170A_L440F_Y441G_R496T_R537S_E559K | |
| 1765 | Y14N_E153K_D168A_E170A_L440F_Y441G_R496T_R537S_E559K | |
| 1766 | Y14N_D168A_E170A_L313M_L440F_Y441G_R496T_R537S_E559K | + |
| 1767 | Y14F_D168A_E170A_L440F_Y441G_T693A | ++ |
| 1768 | Y14F_D168A_E170A_L440F_Y441G_C539A | |
| 1769 | Y14F_D168A_E170A_L440F_Y441G_R496T_R537S_E559K | |
| 1770 | Y14D_R150V_D168A_E170A_L440F_Y441G_R496T_E559N | |
| 1771 | Y14F_D168A_E170A_L440F_Y441G_S698K | |

FIG. 34Q

Table 6: Wild type NOZ 58130 = SEQ ID NO:1316

| SEQ# | Mutations based on SEQ ID NO:1316 | Incorp'n |
|---|---|---|
| 1772 | Y14D_R122S_R150A_D168A_E170A_L440F_Y441G_R496T_R537S_E559K | ++ |
| 1773 | Y14F_R122S_D168A_E170A_L440F_Y441G_A515V | |
| 1774 | Y14N_R122S_E157F_D168A_E170A_L440F_Y441G_R496T_E559K | 0 |
| 1775 | Y14F_D168A_E170A_L440F_Y441G_F523A_E559N | |
| 1776 | Y14N_R122S_R150V_D168A_E170A_L440F_Y441G_R496T_E559N | |
| 1777 | Y14F_D168A_E170A_L440F_Y441G_N759K | + |
| 1778 | Y14F_R150V_D168A_E170A_L440F_Y441G | + |
| 1779 | Y14F_D168A_E170A_L440F_Y441G_K628E | + |
| 1780 | Y14F_D168A_E170A_L440F_Y441G_F523V | + |
| 1781 | Y14N_D168V_E170V_L440F_Y441G_R496T_R537S_E559K | + |
| 1782 | Y14N_R122S_E153K_D168A_E170A_L440F_Y441G_R496T_E559N | + |
| 1783 | Y14N_D168A_E170A_L440F_Y441G_R537S_E559N | |
| 1784 | Y14D_E157F_D168A_E170A_L440F_Y441G_R496T_E559K | + |
| 1785 | Y14N_D168V_E170V_L440F_Y441G_R496T_E559K | |
| 1786 | Y14D_D168A_E170A_L440F_Y441G_R496T_R537S_E559N_N759P | + |
| 1787 | Y14N_E153K_D168A_E170A_L440F_Y441G_R496T_E559N | |
| 1788 | Y14N_R122S_D168A_E170A_L313M_L440F_Y441G_R496T_E559K | |
| 1789 | Y14D_E157F_D168A_E170A_L440F_Y441G_R496T_A515T_R537S_E559K | ++ |
| 1790 | Y14F_D168A_E170A_L440Y_Y441A_P442A_A515T | + |

FIG. 34R

Table 6: Wild type NOZ 58130 = SEQ ID NO:1316

| SEQ# | Mutations based on SEQ ID NO:1316 | Incorp'n |
|---|---|---|
| 1791 | Y14F_D168A_E170A_L440F_Y441G | |
| 1792 | Y14D_R150A_D168A_E170A_L440F_Y441G_R496T_E559K | + |
| 1793 | Y14D_R122S_D168A_E170A_L440F_Y441G_R496T_R537S_E559K | |
| 1794 | Y14D_R122S_D168V_E170V_L440F_Y441G_R496T_R537S_E559N | + |
| 1795 | Y14D_R122S_D168A_E170A_C362L_L440F_Y441G_R496T_R537S_E559K | + |
| 1796 | Y14F_D168A_E170A_L440S_Y441A_A515S | + |
| 1797 | Y14F_D168A_E170A_L440F_Y441G_F523A | ++ |
| 1798 | Y14F_D168A_E170A_L440F_Y441G_A515G | |
| 1799 | Y14D_R122S_D168A_E170A_L440F_Y441G_I480F_R496T_R537S_E559N | + |
| 1800 | Y14N_R122S_D168A_E170A_L313M_L440F_Y441G_R496T_R537S_E559K | |
| 1801 | Y14N_E156N_D168A_E170A_L440F_Y441G_R496T_R537S_E559N | + |
| 1802 | Y14D_R122S_D168A_E170A_L440F_Y441G_R496T_A515T_R537S_E559K | |
| 1803 | Y14F_D168A_E170A_L440F_Y441G_R496G_E559K | + |
| 1804 | Y14F_D168A_E170A_L440F_Y441G_A515R | + |
| 1805 | Y14F_D168A_E170A_A276R_L440F_Y441G | ++ |
| 1806 | Y14N_D168A_E170A_C362L_L440F_Y441G_R496T_A515T_R537S_E559N | |
| 1807 | Y14D_R150V_D168A_E170A_L440F_Y441G_R496T_R537S_E559N | |
| 1808 | Y14F_R122G_G129C_D168A_E170A_L440F_Y441G_A515V | |
| 1809 | Y14N_D168A_E170A_L440F_Y441G_E559K_N759P | 0 |
| 1810 | Y14N_R122S_D168A_E170A_L440F_Y441G_R496T_A515T_R537S_E559N | |

FIG. 34S

Table 6: Wild type NOZ 58130 = SEQ ID NO:1316

| SEQ# | Mutations based on SEQ ID NO:1316 | Incorp'n |
|---|---|---|
| 1811 | Y14N_D168A_E170A_L440F_Y441G_I480F_R537S_E559N | + |
| 1812 | Y14N_R122S_D168A_E170A_C362L_L440F_Y441G_R496T_E559N | |
| 1813 | Y14N_R122S_E156N_D168A_E170A_L440F_Y441G_R496T_R537S_E559K | + |
| 1814 | Y14F_E153L_D168A_E170A_L440F_Y441G | + |
| 1815 | Y14F_D168A_E170A_L440F_Y441G_R496A_A515V | + |
| 1816 | Y14N_R122S_D168A_E170A_C362L_L440F_Y441G_R496T_E559K | |
| 1817 | Y14N_R122S_R150V_D168A_E170A_L440F_Y441G_R496T_R537S_E559N | |
| 1818 | Y14D_R122S_D168A_E170A_L440F_Y441G_I480Y_R496T_R537S_E559N | + |
| 1819 | Y14F_E153A_D168A_E170A_L440F_Y441G | |
| 1820 | Y14D_R122S_E157F_D168A_E170A_L440F_Y441G_R496T_A515T_R537S_E559K | |
| 1821 | Y14N_E156N_D168A_E170A_L440F_Y441G_R496T_A515T_R537S_E559N | |
| 1822 | Y14D_R122S_D168A_E170A_E331N_L440F_Y441G_R496T_E559N | |
| 1823 | Y14D_D168A_E170A_L440F_Y441G | ++ |
| 1824 | Y14D_D168A_E170A_C362L_L440F_Y441G_R496T_A515T_R537S_E559N | + |
| 1825 | Y14N_D168A_E170A_L313M_L440F_Y441G_R496T_E559K | |
| 1826 | Y14D_R122S_D168A_E170A_L440F_Y441G_R496T_A515T_R537S_E559N_N759P | |
| 1827 | Y14N_R122S_E156N_D168A_E170A_L440F_Y441G_R496T_E559N | |
| 1828 | Y14N_D168A_E170A_L440F_Y441G_R496T_A515T_R537S_E559N_N759P | |
| 1829 | D168A_E170A_L440Y_Y441G | + |

FIG. 34T

Table 6: Wild type NOZ 58130 = SEQ ID NO:1316

| SEQ# | Mutations based on SEQ ID NO:1316 | Incorp'n |
|---|---|---|
| 1830 | Y14D_D168A_E170A_E331N_L440F_Y441G_R496T_R537S_E559N | |
| 1831 | Y14D_R122S_E157F_D168A_E170A_L440F_Y441G_R496T_E559K | |
| 1832 | Y14D_R122S_E157F_D168A_E170A_L440F_Y441G_R496T_R537S_E559K | |
| 1833 | Y14D_D168A_E170A_L440F_Y441G_I480Y_R496T_E559K | |
| 1834 | Y14D_R150V_D168A_E170A_L440F_Y441G_R496T_E559K | |
| 1835 | Y14F_D168A_E170A_L440F_Y441G_A515V_S522E | |
| 1836 | Y14N_D168A_E170A_L440F_Y441G_I480Y_R537S_E559N | |
| 1837 | Y14D_R122S_D168A_E170A_C362L_L440F_Y441G_R496T_R537S_E559N | |
| 1838 | Y14D_R122S_D168A_E170A_L440F_Y441G_R496T_A515T_E559N | |
| 1839 | Y14N_D168A_E170A_L440F_Y441G | + |
| 1840 | Y14D_D168A_E170A_L440F_Y441G_R496T_E559K | ++ |
| 1841 | Y14D_D168A_E170A_L313M_L440F_Y441G_R496T_A515T_R537S_E559N | |
| 1842 | Y14N_E156N_D168A_E170A_L440F_Y441G_R496T_E559K | |
| 1843 | Y14N_D168A_E170A_V298I_L440F_Y441G_R496T_R537S_E559N | |
| 1844 | Y14D_R122S_E157F_D168A_E170A_L440F_Y441G_R496T_R537S_E559K | + |
| 1845 | Y14N_D168A_E170A_E331N_L440F_Y441G_R537S_E559N | |
| 1846 | Y14D_D168A_E170A_C362L_L440F_Y441G_R496T_E559K | |
| 1847 | Y14F_D168A_E170A_A515S | |

FIG. 34U

Table 6: Wild type NOZ 58130 = SEQ ID NO:1316

| SEQ# | Mutations based on SEQ ID NO:1316 | Incorp'n |
|---|---|---|
| 1848 | Y14N_R122S_D168A_E170A_L440F_Y441G_A515T_R537S_E559N | + |
| 1849 | Y14F_D168A_E170A_C362L_L440F_Y441G | |
| 1850 | Y14D_D168A_E170A_V298I_L440F_Y441G_R496T_E559N | |
| 1851 | Y14D_D168A_E170A_L440F_Y441G_A515T_R537S_E559N | + |
| 1852 | Y14F_D168A_E170A_V298Y_L440F_Y441G | ++ |
| 1853 | Y14F_D168A_E170A_L440F_Y441G_A515T_E559D | |
| 1854 | Y14F_D168A_E170A_L440F_Y441G_A515T_S522T | |
| 1855 | Y14F_D168A_E170A_L440F_Y441G_R496T_E559K | + |
| 1856 | Y14F_D168A_E170A_L440F_Y441G_E559K | + |
| 1857 | Y14F_E157F_D168A_E170A_L440F_Y441G | |
| 1858 | Y14N_R122S_R150A_D168A_E170A_L440F_Y441G_R496T_E559N | 0 |
| 1859 | Y14F_D168A_E170A_L440F_Y441G_R496T_F523A | + |
| 1860 | Y14F_D168A_E170A_L440Y_Y441A_A515T | + |
| 1861 | Y14F_D168A_E170A_L440Y_Y441A_P442G_A515T | + |
| 1862 | Y14F_D168A_E170A_L440F_Y441G_F523S_E559K | |
| 1863 | Y14D_R150A_D168A_E170A_L440F_Y441G_R496T_E559K | |
| 1864 | Y14D_R122S_D168A_E170A_L440F_Y441G_A515T_R537S_E559N | |
| 1865 | Y14F_D168A_E170A_L440F_Y441G_R496G_E559K | + |
| 1866 | Y14F_D168A_E170A_L440F_Y441G_T690F | + |

FIG. 34V

Table 6: Wild type NOZ 58130 = SEQ ID NO:1316

| SEQ# | Mutations based on SEQ ID NO:1316 | Incorp'n |
|---|---|---|
| 1867 | Y14D_R122S_E157F_D168A_E170A_L440F_Y441G_R496T_E559N | + |
| 1868 | Y14D_R122S_D168A_E170A_L313M_L440F_Y441G_R496T_E559N | + |
| 1869 | Y14D_D168A_E170A_C362L_L440F_Y441G_E559K | |
| 1870 | Y14N_D168A_E170A_L440F_Y441G_I480F_R496T_R537S_E559K | ++ |
| 1871 | Y14F_R122S_D168A_E170A_L440F_Y441G_E559K | |
| 1872 | Y14D_E157F_D168A_E170A_L440F_Y441G_R496T_R537S_E559N | |
| 1873 | Y14F_D168A_E170A_L440F_Y441G_S698D | |
| 1874 | Y14N_E157F_D168A_E170A_L440F_Y441G_R496T_R537S_E559N | + |
| 1875 | Y14F_D168A_E170A_L440F_Y441G_F523T | |
| 1876 | Y14F_V97S_D168A_E170A_L440F_Y441G | |
| 1877 | Y14N_E157F_D168A_E170A_L440F_Y441G_R496T_E559K | |
| 1878 | Y14D_E157F_D168A_E170A_L440F_Y441G_R496T_R537S_E559K | + |
| 1879 | Y14F_E157K_D168A_E170A_L440F_Y441G | + |
| 1880 | Y14D_R122S_E153K_D168A_E170A_L440F_Y441G_R496T_R537S_E559K | + |
| 1881 | Y14D_R122S_R150A_D168A_E170A_L440F_Y441G_R496T_R537S_E559N | |
| 1882 | Y14N_R122S_D168A_E170A_V298I_L440F_Y441G_R496T_A515T_R537S_E559N | |
| 1883 | Y14F_D168A_E170A_L440F_Y441G_A515T_F523S | + |
| 1884 | Y14F_D168A_E170A_L440Y_Y441A | + |
| 1885 | Y14F_D168A_E170A_L440F_Y441G_N759D | |
| 1886 | Y14F_V97F_D168A_E170A_L440F_Y441G | 0 |

FIG. 34W

Table 6: Wild type NOZ 58130 = SEQ ID NO:1316

| SEQ# | Mutations based on SEQ ID NO:1316 | Incorp'n |
|---|---|---|
| 1887 | D168A_E170A | |
| 1888 | Y14D_R122S_D168A_E170A_L440F_Y441G_I480F_R496T_E559K | 0 |
| 1889 | Y14F_D168A_E170A_L440A_Y441A_P442A_A515S | |
| 1890 | Y14N_R122S_R150A_D168A_E170A_L440F_Y441G_R496T_R537S_E559N | |
| 1891 | Y14N_D168V_E170V_L440F_Y441G_R537S_E559N | |
| 1892 | Y14N_E156N_D168A_E170A_L440F_Y441G_R496T_R537S_E559K | |
| 1893 | Y14D_R122S_D168A_E170A_L313M_L440F_Y441G_R496T_E559K | |
| 1894 | Y14N_D168V_E170V_L440F_Y441G_R496T_E559N | |
| 1895 | Y14D_E153K_D168A_E170A_L440F_Y441G_R496T_E559N | + |
| 1896 | Y14F_E156N_D168A_E170A_L440F_Y441G | + |
| 1897 | Y14F_D168A_E170A_L440F_Y441G_Q691F | + |
| 1898 | Y14N_R122S_D168A_E170A_L440F_Y441G_R537S_E559N | |
| 1899 | Y14N_R122S_E157F_D168A_E170A_L440F_Y441G_R496T_E559K | ++ |
| 1900 | Y14F_R122S_D168A_E170A_L440F_Y441G_A515T | 0 |
| 1901 | Y14F_D168A_E170A_L440F_Y441G_F511Y | |
| 1902 | Y14N_D168A_E170A_V298I_L440F_Y441G_R537S_E559N | + |
| 1903 | Y14F_D168A_E170A_L440Y_Y441G_P442A_A515V | |
| 1904 | Y14N_D168A_E170A_L440F_Y441G_A515T_R537S_E559N | |
| 1905 | Y14N_R122S_R150A_D168A_E170A_L440F_Y441G_R496T_R537S_E559N | |

FIG. 34X

Table 6: Wild type NOZ 58130 = SEQ ID NO:1316

| SEQ# | Mutations based on SEQ ID NO:1316 | Incorp'n |
|---|---|---|
| 1906 | Y14N_R122S_R150A_D168A_E170A_L440F_Y441G_R496T_E559K | |
| 1907 | Y14D_E153K_D168A_E170A_L440F_Y441G_R496T_R537S_E559N | + |
| 1908 | Y14F_D168A_E170A_L440F_Y441S_E559N | |
| 1909 | Y14N_R122S_D168A_E170A_L440F_Y441G_I480Y_R496T_E559N | ++ |
| 1910 | Y14N_R122S_D168A_E170A_C362L_L440F_Y441G_R496T_R537S_E559N | + |
| 1911 | Y14D_D168V_E170V_L440F_Y441G_R537S_E559N | |
| 1912 | Y14D_D168A_E170A_L440F_Y441G_R496T_E559N_N759P | + |
| 1913 | Y14N_E153K_D168A_E170A_L440F_Y441G_R496T_R537S_E559N | |
| 1914 | Y14D_E156N_D168A_E170A_L440F_Y441G_R496T_E559N | ++ |
| 1915 | Y14F_D168A_E170A_C362I_L440F_Y441G | + |
| 1916 | Y14F_D168A_E170A_L440Y_Y441A_A515S | |
| 1917 | Y14F_D168A_E170A_L440F_Y441G_A515V_S522K | |
| 1918 | Y14F_D168A_E170A_L440F_Y441G_R496T_R537S_E559N | |
| 1919 | Y14D_R150V_D168A_E170A_L440F_Y441G_R496T_E559K | |
| 1920 | Y14N_E157F_D168A_E170A_L440F_Y441G_R496T_E559N | + |
| 1921 | Y14N_R122S_D168A_E170A_L440F_Y441G_R496T_R537S_E559N | |
| 1922 | Y14N_D168A_E170A_L440F_Y441G_I480Y_R496T_R537S_E559N | + |
| 1923 | Y14F_D168A_E170A_E311A_L440F_Y441G | |
| 1924 | Y14D_E157F_D168A_E170A_L440F_Y441G_R496T_E559N | |

FIG. 34Y

Table 6: Wild type NOZ 58130 = SEQ ID NO:1316

| SEQ# | Mutations based on SEQ ID NO:1316 | Incorp'n |
|---|---|---|
| 1925 | Y14N_D168A_E170A_L440F_Y441G_A515T_R537S_E559K | + |
| 1926 | Y14F_E156R_D168A_E170A_L440F_Y441G | |
| 1927 | Y14D_E156N_D168A_E170A_L440F_Y441G_R496T_E559K | ++ |
| 1928 | Y14F_D168A_E170A_L440F_Y441G_F523I | + |
| 1929 | Y14F_D168A_E170A_L440F_Y441G_T693F | |
| 1930 | Y14N_R122S_R150V_D168A_E170A_L440F_Y441G_R496T_A515T_R537S_E559K | + |
| 1931 | Y14D_R122S_D168V_E170V_L440F_Y441G_R496T_R537S_E559K | + |
| 1932 | Y14D_R122S_D168A_E170A_L440F_Y441G_R496T_E559K | |
| 1933 | Y14D_R122S_D168A_E170A_L440F_Y441G_I480Y_R496T_E559K | + |
| 1934 | Y14F_D168A_E170A_H297A_L440F_Y441G | + |
| 1935 | Y14N_R122S_R150A_D168A_E170A_L440F_Y441G_R496T_R537S_E559K | |
| 1936 | Y14F_R122S_D168A_E170A_L440F_Y441G_R496T_R537S_E559N | |
| 1937 | Y14D_R122S_E157F_D168A_E170A_L440F_Y441G_R496T_A515T_R537S_E559N | + |
| 1938 | Y14F_D168A_E170A_C362S_L440F_Y441G | |
| 1939 | Y14D_R122S_D168A_E170A_L440F_Y441G_R496T_A515T_E559K | 0 |
| 1940 | Y14F_D168A_E170A_L440Y_Y441A_P442G | |
| 1941 | Y14D_R122S_R150A_D168A_E170A_L440F_Y441G_R496T_A515T_R537S_E559N | + |
| 1942 | Y14F_R122K_D168A_E170A_L440F_Y441G_A515V | |
| 1943 | Y14D_R122S_R150V_D168A_E170A_L440F_Y441G_R496T_A515T_R537S_E559N | + |

FIG. 34Z

Table 6: Wild type NOZ 58130 = SEQ ID NO:1316

| SEQ# | Mutations based on SEQ ID NO:1316 | Incorp'n |
|---|---|---|
| 1944 | Y14N_R122S_D168A_E170A_L440F_Y441G_E559N | ++ |
| 1945 | Y14F_R122K_D168A_E170A_L440F_Y441G_A515T | + |
| 1946 | Y14F_R122D_D168A_E170A_L440F_Y441G_A515V | |
| 1947 | Y14N_R150A_D168A_E170A_L440F_Y441G_R496T_R537S_E559K | + |
| 1948 | Y14N_D168V_E170V_L440F_Y441G_R496T_R537S_E559N | 0 |
| 1949 | Y14F_D168A_E170A_L440F_Y441G_R496A_E559N | |
| 1950 | Y14D_R122S_R150V_D168A_E170A_L440F_Y441G_R496T_R537S_E559N | |
| 1951 | Y14N_R122S_D168A_E170A_L440F_Y441G_R496T_E559N_N759P | |
| 1952 | Y14D_R150V_D168A_E170A_L440F_Y441G_R496T_A515T_R537S_E559N | + |
| 1953 | Y14F_D168A_E170A_L440Y_Y441G_A515T | + |
| 1954 | Y14F_D168A_E170A_L440F_Y441G_D671R | |
| 1955 | Y14N_R150A_D168A_E170A_L440F_Y441G_R496T_R537S_E559K | + |
| 1956 | Y14F_D168A_E170A_L440F_Y441G_R537E_E559N | |
| 1957 | Y14N_R122S_D168A_E170A_L440F_Y441G_I480Y_R496T_E559K | + |
| 1958 | Y14F_D168A_E170A_L440F_Y441G_R496T_E559N | |
| 1959 | Y14D_R122S_E156N_D168A_E170A_L440F_Y441G_R496T_A515T_R537S_E559N | 0 |
| 1960 | Y14F_D168A_E170A_L440F_Y441G_A515V_R537G | + |
| 1961 | Y14F_D168A_E170A_L360I_L440F_Y441G | |

FIG. 34AA

Table 6: Wild type NOZ 58130 = SEQ ID NO:1316

| SEQ# | Mutations based on SEQ ID NO:1316 | Incorp'n |
|---|---|---|
| 1962 | Y14D_D168A_E170A_C362L_L440F_Y441G_R496T_E559N | |
| 1963 | Y14D_R122S_D168A_E170A_V298I_L440F_Y441G_R496T_R537S_E559K | + |
| 1964 | Y14F_D168A_E170A_L440Y_Y441G_P442A_A515T | + |
| 1965 | Y14D_D168A_E170A_L440F_Y441G_R496T_A515T_R537S_E559K | + |
| 1966 | Y14F_E157L_D168A_E170A_L440F_Y441G | + |
| 1967 | Y14F_D168A_E170A_E406N_L440F_Y441G | ++ |
| 1968 | Y14D_D168A_E170A_L440F_Y441G_R496T_A515T_R537S_E559N | |
| 1969 | Y14D_E157F_D168A_E170A_L440F_Y441G_R496T_E559K | + |
| 1970 | Y14F_D168A_E170A_E184N_L440F_Y441G | + |
| 1971 | Y14F_D168A_E170A_C362F_L440F_Y441G | ++ |
| 1972 | Y14F_D168A_E170A_L440F_Y441G_C539S | |
| 1973 | Y14D_R122S_D168A_E170A_V298I_L440F_Y441G_R496T_E559K | |
| 1974 | Y14D_E156N_D168A_E170A_L440F_Y441G_R496T_R537S_E559N | |
| 1975 | Y14D_R122S_D168A_E170A_L440F_Y441G_R496T_R537S_E559N_N759P | 0 |
| 1976 | Y14F_D168A_E170A_L440F_Y441G_S522E | + |
| 1977 | Y14F_D168A_E170A_E406N_E407N_L440F_Y441G | |
| 1978 | Y14N_R122S_D168A_E170A_V298I_L440F_Y441G_R496T_E559N | + |
| 1979 | Y14N_R122S_E153K_D168A_E170A_L440F_Y441G_R496T_E559K | |
| 1980 | Y14D_E153K_D168A_E170A_L440F_Y441G_R496T_A515T_R537S_E559N | 0 |

FIG. 34BB

Table 6: Wild type NOZ 58130 = SEQ ID NO:1316

| SEQ# | Mutations based on SEQ ID NO:1316 | Incorp'n |
|---|---|---|
| 1981 | Y14F_D168A_E170A_L440F_Y441G_A515V_R537K | + |
| 1982 | Y14F_D168A_E170A_L440F_Y441G_T693P | |
| 1983 | Y14D_D168A_E170A_L440F_Y441G_A515T_R537S_E559K | |
| 1984 | Y14D_R150A_D168A_E170A_L440F_Y441G_R496T_R537S_E559N | ++ |
| 1985 | Y14F_D168Y_E170A_L440F_Y441G | + |
| 1986 | Y14D_D168V_E170V_L440F_Y441G_R496T_R537S_E559K | + |
| 1987 | Y14F_D168A_E170A_C362A_L440F_Y441G | |
| 1988 | Y14D_D168A_E170A_L440F_Y441G_I480Y_R496T_E559N | + |
| 1989 | Y14N_D168A_E170A_L440F_Y441G_R537S_E559K | |
| 1990 | Y14D_R122S_R150V_D168A_E170A_L440F_Y441G_R496T_R537S_E559K | + |
| 1991 | Y14F_D168A_E170A_H297T_L440F_Y441G | |
| 1992 | Y14N_R150A_D168A_E170A_L440F_Y441G_R496T_E559K | + |
| 1993 | Y14D_D168A_E170A_E331N_L440F_Y441G_R496T_R537S_E559K | + |
| 1994 | Y14N_R122S_D168A_E170A_C362L_L440F_Y441G_R496T_R537S_E559K | |
| 1995 | Y14F_D168A_E170A_L364I_L440F_Y441G | + |
| 1996 | Y14D_R122S_E153K_D168A_E170A_L440F_Y441G_R496T_E559K | |
| 1997 | Y14N_R122S_E156N_D168A_E170A_L440F_Y441G_R496T_A515T_R537S_E559N | + |
| 1998 | Y14F_D168A_E170A_L440F_Y441G_K628D | 0 |
| 1999 | Y14F_D168A_E170A_L440F_Y441G_S522N | |
| 2000 | Y14D_D168A_E170A_L440F_Y441G_I480F_R496T_E559K | |

FIG. 34CC

Table 6: Wild type NOZ 58130 = SEQ ID NO:1316

| SEQ# | Mutations based on SEQ ID NO:1316 | Incorp'n |
|---|---|---|
| 2001 | Y14D_R122S_D168A_E170A_L440F_Y441G_R496T_E559K_N759P | |
| 2002 | Y14F_E108R_D168A_E170A_L440F_Y441G | + |
| 2003 | Y14F_D168A_E170A_L440F_Y441G_A720D | |
| 2004 | Y14F_R122S_D168A_E170A_L440F_Y441G_R496T_E559N | + |
| 2005 | Y14N_D168A_E170A_L440F_Y441G_R496T_E559N | |
| 2006 | D168A_E170A_L440Y_Y441A | |
| 2007 | Y14F_D168A_E170A_L440F_Y441G_N759T | |
| 2008 | Y14F_D168A_E170Y_L440F_Y441G | |
| 2009 | Y14N_D168A_E170A_V298I_L440F_Y441G_R496T_E559N | |
| 2010 | Y14N_E157F_D168A_E170A_L440F_Y441G_R496T_R537S_E559N | |
| 2011 | Y14F_D168A_E170A_L440F_Y441G_R496T_A515T_R537S_E559N | + |
| 2012 | Y14F_E108N_D168A_E170A_L440F_Y441G | + |
| 2013 | Y14D_D168V_E170V_L440F_Y441G_R496T_R537S_E559N | + |
| 2014 | Y14D_R122S_D168V_E170V_L440F_Y441G_R496T_E559N | 0 |
| 2015 | Y14F_D168A_E170A_L440F_Y441G_S522D_E559K | |
| 2016 | Y14N_D168A_E170A_L440F_Y441G_I480Y_R496T_R537S_E559K | + |
| 2017 | Y14N_R122S_E153K_D168A_E170A_L440F_Y441G_R496T_R537S_E559K | + |
| 2018 | Y14N_D168A_E170A_L313M_L440F_Y441G_R496T_E559N | + |
| 2019 | Y14D_R122S_D168A_E170A_L440F_Y441G_E559N | + |

FIG. 34DD

Table 6: Wild type NOZ 58130 = SEQ ID NO:1316

| SEQ# | Mutations based on SEQ ID NO:1316 | Incorp'n |
|---|---|---|
| 2020 | Y14N_R122S_D168A_E170A_L440F_Y441G_R496T_A515T_R537S_E559K | + |
| 2021 | Y14F_D168A_E170A_L440Y_Y441G_P442A_A515L | |
| 2022 | Y14N_R122S_D168A_E170A_L440F_Y441G_A515T_E559N | + |
| 2023 | Y14N_R122S_D168A_E170A_V298I_L440F_Y441G_R496T_R537S_E559K | + |
| 2024 | Y14F_D168L_E170A_L440F_Y441G | + |
| 2025 | Y14F_D168A_E170A_C362Y_L440F_Y441G | 0 |
| 2026 | Y14F_D168A_E170A_L440F_Y441G_S522K | |
| 2027 | Y14D_D168A_E170A_L440F_Y441G_I480F_R537S_E559N | + |
| 2028 | Y14N_D168A_E170A_C362L_L440F_Y441G_R496T_E559N | + |
| 2029 | Y14F_D168A_E170A_H297F_L440F_Y441G | |
| 2030 | Y14D_D168A_E170A_L440F_Y441G_I480F_R496T_R537S_E559N | |
| 2031 | Y14D_D168A_E170A_L440F_Y441G_R496T_R537S_E559K_N759P | |
| 2032 | Y14D_R150V_D168A_E170A_L440F_Y441G_R496T_E559N | + |
| 2033 | Y14F_E153K_D168A_E170A_L440F_Y441G | |
| 2034 | Y14N_D168A_E170A_L440F_Y441G_R537S_E559N_N759P | 0 |
| 2035 | Y14F_D168A_E170A_L440F_Y441G_A515T_R537E | + |
| 2036 | Y14F_D168A_E170A_L440F_Y441A_P442G_A515V | ++ |
| 2037 | Y14F_D168A_E170A_L388Y_L440F_Y441G | + |
| 2038 | Y14D_R122S_R150A_D168A_E170A_L440F_Y441G_R496T_E559K | |

FIG. 34EE

Table 6: Wild type NOZ 58130 = SEQ ID NO:1316

| SEQ# | Mutations based on SEQ ID NO:1316 | Incorp'n |
|---|---|---|
| 2039 | Y14N_R150A_D168A_E170A_L440F_Y441G_R496T_E559N | + |
| 2040 | Y14F_D168A_E170A_L440F_Y441G_F511H | + |
| 2041 | Y14D_D168A_E170A_L440F_Y441G_R537S_E559N | |
| 2042 | Y14N_R150V_D168A_E170A_L440F_Y441G_R496T_R537S_E559K | + |
| 2043 | Y14N_R122S_D168V_E170V_L440F_Y441G_R496T_R537S_E559N | |
| 2044 | Y14D_E153K_D168A_E170A_L440F_Y441G_R496T_A515T_R537S_E559K | |
| 2045 | Y14D_R122S_E153K_D168A_E170A_L440F_Y441G_R496T_A515T_R537S_E559K | ++ |
| 2046 | Y14F_R122G_D168A_E170A_L440F_Y441G_A515T | |
| 2047 | Y14D_R122S_D168A_E170A_L440F_Y441G_I480Y_R496T_E559N | + |
| 2048 | Y14D_D168A_E170A_E331N_L440F_Y441G_R496T_E559K | + |
| 2049 | Y14D_D168V_E170V_L440F_Y441G_R496T_E559N | + |
| 2050 | Y14N_R122S_D168V_E170V_L440F_Y441G_R496T_E559N | + |
| 2051 | Y14F_R122G_D168A_E170A_L440F_Y441G_A515V | + |
| 2052 | Y14N_D168A_E170A_L313M_L440F_Y441G_R537S_E559N | + |
| 2053 | Y14F_D168A_E170A_H297Y_L440F_Y441G | |
| 2054 | Y14D_R122S_E153K_D168A_E170A_L440F_Y441G_R496T_R537S_E559N | |
| 2055 | Y14F_V97Y_D168A_E170A_L440F_Y441G | + |
| 2056 | Y14N_D168A_E170A_E331N_L440F_Y441G_E559K | + |

FIG. 34FF

Table 6: Wild type NOZ 58130 = SEQ ID NO:1316

| SEQ# | Mutations based on SEQ ID NO:1316 | Incorp'n |
|---|---|---|
| 2057 | Y14F_D168A_E170A_L440A_Y441A_P442A_A515L | 0 |
| 2058 | Y14F_D168A_E170A_L440Y_Y441G_P442A_A515S | + |
| 2059 | Y14D_R122S_D168A_E170A_L440F_Y441G_R537S_E559K | |
| 2060 | Y14N_R122S_D168A_E170A_L440F_Y441G_I480F_R496T_R537S_E559N | + |
| 2061 | Y14N_R122S_D168A_E170A_L440F_Y441G_R496T_E559K | |
| 2062 | Y14N_R122S_D168A_E170A_L440F_Y441G_I480Y_R496T_A515T_R537S_E559N | + |
| 2063 | Y14D_D168A_E170A_V298I_L440F_Y441G_R537S_E559N | + |
| 2064 | Y14D_R122S_E157F_D168A_E170A_L440F_Y441G_R496T_R537S_E559N | + |
| 2065 | Y14D_D168A_E170A_L313M_L440F_Y441G_R496T_R537S_E559K | 0 |
| 2066 | Y14N_R122S_D168A_E170A_E331N_L440F_Y441G_R496T_A515T_R537S_E559N | + |
| 2067 | Y14N_D168A_E170A_C362L_L440F_Y441G_R496T_E559K | |
| 2068 | Y14F_D168A_E170A_L440F_Y441G_E703S | + |
| 2069 | Y14F_D168A_E170A_L440F_Y441G_M555I | + |
| 2070 | Y14F_D168A_E170A_L440F_Y441G_E703R | 0 |
| 2071 | Y14F_W135R_D168A_E170A_L440F_Y441G | |
| 2072 | Y14F_D168A_E170A_A276Q_L440F_Y441G | + |
| 2073 | Y14N_R122S_E157F_D168A_E170A_E331N_L440F_Y441G_R537S_E559N | |
| 2074 | Y14F_D168A_E170A_A352D_C362L_L440F_Y441G | |
| 2075 | Y14N_R122S_D168V_E170V_L440F_Y441G_R537S_E559N | |

FIG. 34GG

Table 6: Wild type NOZ 58130 = SEQ ID NO:1316

| SEQ# | Mutations based on SEQ ID NOS: 1316 | Incorp'n |
|---|---|---|
| 2076 | Y14N_R122S_R150A_D168A_E170A_Y408R_L440F_Y441G_R496T_R537S_E559N | |
| 2077 | Y14D_D168A_E170A_E331N_L440F_Y441G_A515T_R537S_E559N | |
| 2078 | Y14F_D168A_E170A_R422T_L440F_Y441G | + |
| 2079 | Y14F_D168A_E170A_L440F_Y441G_C539N | + |
| 2080 | Y14N_R122S_E157F_D168A_E170A_L440F_Y441G_I480Y_R537S_E559N | |
| 2081 | Y14F_D168A_E170A_C362K_L440F_Y441G | + |
| 2082 | Y14N_R122S_R150V_D168A_E170A_E331N_L440F_Y441G_R496T_R537S_E559N | |
| 2083 | Y14N_D168A_E170A_C362L_L440F_Y441G_A515T_R537S_E559N | |
| 2084 | Y14N_D168A_E170A_E331N_L440F_Y441G_A515T_R537S_E559N | |
| 2085 | Y14N_R122S_E157F_D168V_E170V_L440F_Y441G_R537S_E559N | |
| 2086 | Y14N_R150V_D168A_E170A_E331N_L440F_Y441G_R496T_A515T_R537S_E559N | |
| 2087 | Y14D_R150A_D168A_E170A_E331N_L440F_Y441G_R496T_A515T_R537S_E559N | |
| 2088 | Y14F_D168A_E170A_R413Q_L440F_Y441G | + |
| 2089 | Y14F_D168A_E170A_C362N_L440F_Y441G | + |
| 2090 | Y14D_D168A_E170A_L313M_L440F_Y441G_A515T_R537S_E559N | |
| 2091 | Y14F_D168A_E170A_A352Q_L440F_Y441G | |
| 2092 | Y14N_R122S_E157F_D168A_E170A_L313M_L440F_Y441G_R537S_E559N | |
| 2093 | Y14N_R122S_R150V_D168A_E170A_C362L_L440F_Y441G_R537S_E559K | |
| 2094 | Y14F_D168A_E170A_K319V_C362L_L440F_Y441G | |
| 2095 | Y14F_D168A_E170A_L440F_Y441G_G735T | + |

FIG. 34HH

Table 6: Wild type NOZ 58130 = SEQ ID NO:1316

| SEQ# | Mutations based on SEQ ID NOS: 1316 | Incorp'n |
|---|---|---|
| 2096 | Y14N_R122S_R150V_D168A_E170A_L440F_Y441G_I480Y_R537S_E559K | |
| 2097 | Y14F_D168A_E170A_L440F_Y441G_C539P | + |
| 2098 | Y14N_R122S_E157F_D168A_E170A_C362L_L440F_Y441G_R537S_E559N | |
| 2099 | Y14N_R122S_E157A_D168A_E170A_E331N_L440F_Y441G_R496T_R537S_E559N | |
| 2100 | Y14N_E157A_D168A_E170A_L313M_L440F_Y441G_R496T_A515T_R537S_E559N | |
| 2101 | Y14N_R122S_D168A_E170A_L313M_L440F_Y441G_R537S_E559N | |
| 2102 | Y14N_D168A_E170A_L313M_L440F_Y441G_A515T_R537S_E559N | |
| 2103 | Y14F_D168A_E170A_R422D_L440F_Y441G | 0 |
| 2104 | Y14N_R122S_R150A_D168A_E170A_C362L_L440F_Y441G_R537S_E559N | |
| 2105 | Y14N_R122S_E157F_D168A_E170A_L440F_Y441G_I480F_R537S_E559N | |
| 2106 | Y14F_D168A_E170A_L440F_Y441G_S701E | + |
| 2107 | Y14N_R122S_R150A_D168A_E170A_L440F_Y441G_R496T_R537S_E559N_Y774^ | |
| 2108 | Y14N_R122S_R150A_D168A_E170A_L440F_Y441G_R496T_R537S_E559N_G773^ | |
| 2109 | Y14N_R122S_R150V_D168A_E170A_C362L_L440F_Y441G_R496T_R537S_E559N | |
| 2110 | Y14F_D168A_E170A_L440F_Y441G_Q738D | 0 |
| 2111 | Y14F_D168A_E170A_Y408R_L440F_Y441G | |
| 2112 | Y14F_D168A_E170A_L440F_Y441G_S701T | + |
| 2113 | Y14N_R122S_R150A_D168A_E170A_L313M_L440F_Y441G_R537S_E559N | |
| 2114 | Y14N_R122S_D168A_E170A_C362L_L440F_Y441G_R537S_E559N | |
| 2115 | Y14F_D168A_E170A_L338E_L440F_Y441G | |

FIG. 34II

Table 6: Wild type NOZ 58130 = SEQ ID NO:1316

| SEQ# | Mutations based on SEQ ID NOS: 1316 | Incorp'n |
|---|---|---|
| 2116 | Y14N_R150V_D168A_E170A_C362L_L440F_Y441G_R496T_A515T_R537S_E559N | |
| 2117 | Y14F_W135L_D168A_E170A_L440F_Y441G | |
| 2118 | Y14F_D168A_E170A_L440F_Y441G_G773^ | |
| 2119 | Y14N_R122S_R150A_D168V_E170V_L440F_Y441G_R537S_E559N | |
| 2120 | Y14F_D168A_E170A_F326N_L440F_Y441G | |
| 2121 | Y14D_E157A_D168A_E170A_E331N_L440F_Y441G_R496T_A515T_R537S_E559N | |
| 2122 | Y14N_R122S_R150A_D168A_E170A_L440F_Y441G_R496T_R537S_E559N_R790^ | |
| 2123 | Y14F_D168A_E170A_L277M_L440F_Y441G | + |
| 2124 | Y14F_D168A_E170A_L440F_Y441G_Y774^ | |
| 2125 | Y14N_R122S_R150V_D168A_E170A_C362L_L440F_Y441G_R496T_R537S_E559K | |
| 2126 | Y14N_R122S_E157F_D168A_E170A_L440F_Y441G_R537S_E559N_N759P | |
| 2127 | Y14N_R122S_D168A_E170A_V298I_L440F_Y441G_R537S_E559N | |
| 2128 | Y14F_D168A_E170A_L440F_Y441G_G735E | + |
| 2129 | Y14N_E157A_D168A_E170A_E331N_L440F_Y441G_R496T_A515T_R537S_E559N | |
| 2130 | Y14F_D168A_E170A_V288F_C362L_L440F_Y441G | |
| 2131 | Y14F_D168A_E170A_C362D_L440F_Y441G | + |
| 2132 | Y14F_D168A_E170A_L440F_Y441G_R767E | 0 |
| 2133 | Y14N_R122S_R150A_D168A_E170A_E331N_L440F_Y441G_R537S_E559N | |
| 2134 | Y14D_R150A_D168A_E170A_C362L_L440F_Y441G_R496T_R537S_E559N | |
| 2135 | Y14F_D168A_E170A_L290I_L440F_Y441G | |

FIG. 34JJ

Table 6: Wild type NOZ 58130 = SEQ ID NO:1316

| SEQ# | Mutations based on SEQ ID NOS: 1316 | Incorp'n |
|---|---|---|
| 2136 | Y14F_D168A_E170A_L440F_Y441G_C539D | + |
| 2137 | Y14D_R150A_D168A_E170A_L313M_L440F_Y441G_R496T_A515T_R537S_E559N | |
| 2138 | Y14N_R122S_R150V_D168A_E170A_V298I_L440F_Y441G_R537S_E559K | |
| 2139 | Y14N_R122S_E157A_D168A_E170A_C362L_L440F_Y441G_R496T_R537S_E559N | |
| 2140 | Y14F_D117(del)_D168A_E170A_L440F_Y441G | + |
| 2141 | Y14N_R122S_R150V_D168V_E170V_L440F_Y441G_R537S_E559K | |
| 2142 | Y14F_D168A_E170A_L440F_Y441G_S737R | + |
| 2143 | Y14F_D168A_E170A_L440F_Y441G_R619E | 0 |
| 2144 | Y14N_R122S_R150A_D168A_E170A_L440F_Y441G_I480F_R537S_E559N | |
| 2145 | Y14N_R122S_R150V_D168A_E170A_V298I_L440F_Y441G_R496T_R537S_E559N | |
| 2146 | Y14F_D168A_E170A_A276M_L440F_Y441G | + |
| 2147 | Y14F_D168A_E170A_L440F_Y441G_G735S | + |
| 2148 | Y14F_D168A_E170A_L440F_Y441G_Q785^ | |
| 2149 | Y14F_D168A_E170A_C362L_L440F_Y441G_L585K | |
| 2150 | Y14N_R122S_R150V_D168A_E170A_L440F_Y441G_R537S_E559K_N759P | |
| 2151 | Y14N_R150A_D168A_E170A_C362L_L440F_Y441G_R496T_A515T_R537S_E559N | |
| 2152 | Y14F_D168A_E170A_L440F_Y441G_S701R | + |
| 2153 | Y14N_R122S_R150V_D168A_E170A_L313M_L440F_Y441G_R496T_R537S_E559N | |
| 2154 | Y14N_R122S_R150A_D168A_E170A_L440F_Y441G_R496T_R537S_E559N_Q785^ | |
| 2155 | Y14F_D168A_E170A_L440F_Y441G_M723N | |

FIG. 34KK

Table 6: Wild type NOZ 58130 = SEQ ID NO:1316

| SEQ# | Mutations based on SEQ ID NOS: 1316 | Incorp'n |
|---|---|---|
| 2156 | Y14N_R122S_E157A_D168A_E170A_L313M_L440F_Y441G_R496T_R537S_E559N | |
| 2157 | Y14N_R122S_R150A_D168A_E170A_L440F_Y441G_R537S_E559N_N759P | |
| 2158 | Y14F_D168A_E170A_L440F_Y441G_M723T | |
| 2159 | Y14F_D168A_E170A_L440F_Y441G_D758N | + |
| 2160 | Y14F_D168A_E170A_A276N_L440F_Y441G | + |
| 2161 | Y14N_R122S_W135R_R150A_D168A_E170A_L440F_Y441G_R496T_R537S_E559N | |
| 2162 | Y14N_E157A_D168A_E170A_C362L_L440F_Y441G_R496T_A515T_R537S_E559N | |
| 2163 | Y14N_R122S_R150V_D168A_E170A_E331N_L440F_Y441G_R537S_E559K | |
| 2164 | Y14N_R150A_D168A_E170A_E331N_L440F_Y441G_R496T_A515T_R537S_E559N | |
| 2165 | Y14F_D168A_E170A_C362P_L440F_Y441G | + |
| 2166 | Y14F_D168A_E170A_L440F_Y441G_G735P | + |
| 2167 | Y14F_D168A_E170A_C362L_L440F_Y441G_Y774^ | |
| 2168 | Y14N_R122S_W135S_R150A_D168A_E170A_L440F_Y441G_R496T_R537S_E559N | |
| 2169 | Y14N_R150A_D168A_E170A_L313M_L440F_Y441G_R496T_A515T_R537S_E559N | |
| 2170 | Y14F_W135S_D168A_E170A_L440F_Y441G | |
| 2171 | Y14N_R122S_E157A_D168A_E170A_V298I_L440F_Y441G_R496T_R537S_E559N | |
| 2172 | Y14N_R122S_D168A_E170A_E331N_L440F_Y441G_R537S_E559N | |
| 2173 | Y14F_D168A_E170A_R411D_L440F_Y441G | 0 |
| 2174 | Y14F_D168A_E170A_D330N_C362L_L440F_Y441G | |
| 2175 | Y14F_D168A_E170A_L440F_Y441G_F523Y | |

FIG. 34LL

Table 6: Wild type NOZ 58130 = SEQ ID NO:1316

| SEQ# | Mutations based on SEQ ID NOS: 1316 | Incorp'n |
|---|---|---|
| 2176 | Y14N_R122S_W135L_R150A_D168A_E170A_L440F_Y441G_R496T_R537S_E559N | |
| 2177 | Y14F_D168A_E170A_L440F_Y441G_V566N | |
| 2178 | Y14N_R150V_D168A_E170A_L313M_L440F_Y441G_R496T_A515T_R537S_E559N | |
| 2179 | Y14N_R122S_R150A_D168A_E170A_L440F_Y441G_I480Y_R537S_E559N | |
| 2180 | Y14D_R150V_D168A_E170A_E331N_L440F_Y441G_R496T_A515T_R537S_E559N | |
| 2181 | Y14D_R150V_D168A_E170A_C362L_L440F_Y441G_R496T_R537S_E559N | |
| 2182 | Y14F_D168A_E170A_L440F_Y441G_D777^ | |
| 2183 | Y14N_R122S_R150V_D168V_E170V_L440F_Y441G_R496T_R537S_E559N | |
| 2184 | Y14D_R150V_D168A_E170A_L313M_L440F_Y441G_R496T_A515T_R537S_E559N | |
| 2185 | Y14F_D168A_E170A_D330E_C362L_L440F_Y441G | |
| 2186 | Y14N_R122S_R150A_D168A_E170A_L440F_Y441G_R496T_R537S_E559N_W791R_F792^ | |
| 2187 | Y14F_D168A_E170A_L440F_Y441G_D752Q | + |
| 2188 | Y14F_D168A_E170A_L277R_L440F_Y441G | + |
| 2189 | Y14F_D168A_E170A_R422V_L440F_Y441G | + |
| 2190 | Y14F_D168A_E170A_L338E_C362L_L440F_Y441G | |
| 2191 | Y14D_E157A_D168A_E170A_L313M_L440F_Y441G_R496T_A515T_R537S_E559N | |
| 2192 | Y14F_D168A_E170A_M378R_L440F_Y441G | 0 |
| 2193 | Y14N_R122S_R150A_D168A_E170A_V298I_L440F_Y441G_R537S_E559N | |
| 2194 | Y14N_R122S_R150V_D168A_E170A_L313M_L440F_Y441G_R537S_E559K | |
| 2195 | Y14F_D168A_E170A_L440F_Y441G_M555Y | + |

FIG. 34MM

Table 6: Wild type NOZ 58130 = SEQ ID NO:1316

| SEQ# | Mutations based on SEQ ID NOS: 1316 | Incorp'n |
|---|---|---|
| 2196 | Y14F_D168A_E170A_E407R_L440F_Y441G | + |
| 2197 | Y14F_E76Q_D168A_E170A_C362L_L440F_Y441G | |
| 2198 | Y14F_D168A_E170A_L440F_Y441G_S737E | 0 |
| 2199 | Y14D_E157A_D168A_E170A_C362L_L440F_Y441G_R496T_R537S_E559N | |
| 2200 | Y14F_D168A_E170A_L440F_Y441G_R790^ | |
| 2201 | Y14F_D168A_E170A_M378A_L440F_Y441G | + |
| 2202 | Y14N_R122S_R150A_D168A_E170A_L440F_Y441G_R496T_R537S_E559N_W791R_F792R | |
| 2203 | Y14F_D168A_E170A_G275S_L440F_Y441G | |
| 2204 | Y14F_D168A_E170A_L440F_Y441G_Q738E | + |
| 2205 | Y14N_R122S_E157F_D168A_E170A_V298I_L440F_Y441G_R537S_E559N | |
| 2206 | Y14F_D168A_E170A_M378T_L440F_Y441G | + |
| 2207 | Y14F_D168A_E170A_R413T_L440F_Y441G | + |
| 2208 | Y14F_D168A_E170A_L440F_Y441G_Q738S | + |
| 2209 | Y14F_D168A_E170A_L440F_Y441G_C539K | + |
| 2210 | Y14F_D168A_E170A_L440F_Y441G_E565S | |
| 2211 | Y14F_D168A_E170A_L440F_Y441G_D752T | + |
| 2212 | Y14N_R122S_R150A_D168A_E170A_L440F_Y441G_R496T_R537S_E559N_D777^ | |
| 2213 | Y14N_R122S_R150V_D168A_E170A_L440F_Y441G_I480F_R537S_E559K | |
| 2214 | Y14N_R122S_E157A_D168V_E170V_L440F_Y441G_R496T_R537S_E559N | |

FIG. 34NN

Table 7: Wild type RMF 90817 = SEQ ID NO:2215

| SEQ# | Mutations based on SEQ ID NO:2215 | Incorp'n |
|---|---|---|
| 2216 | D149A_E151A_L421Y_Y422G_P423A | + |
| 2217 | D149A_E151A_L421S_Y422G | 0 |
| 2218 | D149A_E151A_L421A_Y422A_P423G | + |
| 2219 | D149A_E151A_L421F_Y422G | + |
| 2220 | D149A_E151A_L421S_Y422G_P423A | 0 |
| 2221 | D149A_E151A_L421S_Y422A_P423G | 0 |
| 2222 | D149A_E151A_L421S_Y422A | + |
| 2223 | D149A_E151A_L421F_Y422A_P423G | ++ |
| 2224 | D149A_E151A_L421A_Y422G_P423A | 0 |
| 2225 | D149A_E151A_L421A_Y422A_P423A | + |
| 2226 | D149A_E151A_L421Y_Y422A_P423G | 0 |
| 2227 | D149A_E151A_L421F_Y422A | ++ |
| 2228 | D149A_E151A_L421Y_Y422A | ++ |
| 2229 | D149A_E151A_L421F_Y422G_P423A | + |
| 2230 | D149A_E151A_L421A_Y422G | + |
| 2231 | D149A_E151A_L421Y_Y422G_T525S | + |
| 2232 | D149A_E151A_L421Y_Y422G | + |
| 2233 | D149A_E151A_L421S_Y422A_P423A | + |
| 2234 | D149A_E151A_L421A_Y422A | + |
| 2235 | D149A_E151A_L421F_Y422A_P423A | + |
| 2236 | D149A_E151A_L421Y_Y422A_P423A | 0 |

FIG. 35

Table 8: Wild type RMF 90817 = SEQ ID NO:2215

| SEQ# | Mutations based on SEQ ID NO:2215 |
|---|---|
| 2237 | D149A_E151A_Y272A_C307A_L421F_Y422A_C520A_T525S |
| 2238 | D149A_E151A_C307V_L421Y_Y422G_T525S |
| 2239 | D149A_E151A_C307V_L421F_Y422G_T525S |
| 2240 | D149A_E151A_L421A_Y422A_T525A |
| 2241 | D149A_E151A_L421Y_Y422A_T525S_S523A |
| 2242 | D149A_E151A_Y272A_C307V_L421F_Y422G_T525S |
| 2243 | D149A_E151A_L421S_Y422A_T525A |
| 2244 | D149A_E151A_L421F_Y422G_T525A |
| 2245 | D149A_E151A_L421Y_Y422A_T525A |
| 2246 | D149A_E151A_L421A_Y422A_T525S |
| 2247 | D149A_E151A_L421F_Y422A_T525S |
| 2248 | D149A_E151A_Y272A_C307A_L421F_Y422G_T525S |
| 2249 | D149A_E151A_L421S_Y422A_A496S |
| 2250 | D149A_E151A_L421F_Y422G_A496T |
| 2251 | D149A_E151A_Y272A_C307V_L421Y_Y422G_C520A_T525S |
| 2252 | D149A_E151A_L421S_Y422A_T525S |
| 2253 | Y11F_D149A_E151A_C307A_L421F_Y422G_C520A_T525S |
| 2254 | Y11F_D149A_E151A_L421A_Y422A |
| 2255 | Y11F_D149A_E151A_L421F_Y422A |
| 2256 | Y11F_D149A_E151A_C307A_L421Y_Y422G_T525S |
| 2257 | D149A_E151A_Y272A_Y422A |
| 2258 | D149A_E151A_L421A_Y422A_P423G_A496V |
| 2259 | D149A_E151A_L421S_Y422A_P423A_T525S_S523A |
| 2260 | D149A_E151A_L421F_Y422A_P423A_T525A |

FIG. 36A

Table 8: Wild type RMF 90817 = SEQ ID NO:2215

| SEQ# | Mutations based on SEQ ID NO:2215 |
|---|---|
| 2261 | D149A_E151A_L421A_Y422A_A496L |
| 2262 | D149A_E151A_L421Y_Y422G_A496S |
| 2263 | D149A_E151A_L421F_Y422A_P423G_A496V |
| 2264 | D149A_E151A_L421S_Y422A_P423A_A496S |
| 2265 | D149A_E151A_L421F_Y422A_P423A_A496V |
| 2266 | D149A_E151A_L421A_Y422A_T525S_S523A |
| 2267 | D149A_E151A_Y272A_C307A_L421F_Y422A_T525S |
| 2268 | D149A_E151A_C307V_L421F_Y422A_C520A_T525S |
| 2269 | Y11F_D149A_E151A_Y272A_C307A_L421Y_Y422G_T525S |
| 2270 | D149A_E151A_C307V_L421F_Y422G_C520A_T525S |
| 2271 | D149A_E151A_L421A_Y422A_P423G_T525A |
| 2272 | D149A_E151A_L421F_Y422G_A496V |
| 2273 | D149A_E151A_L421S_Y422A_A496T |
| 2274 | Y11F_D149A_E151A_C307V_L421F_Y422A_C520A_T525S |
| 2275 | D149A_E151A_L421F_Y422A_P423G_A496L |
| 2276 | Y11F_D149A_E151A_Y272A_C307V_L421F_Y422G_T525S |
| 2277 | D149A_E151A_L421Y_Y422A_A496T |
| 2278 | Y11F_D149A_E151A_L421Y_Y422G |
| 2279 | D149A_E151A_Y272A_C307A_L421Y_Y422G_T525S |
| 2280 | D149A_E151A_L421F_Y422A_P423G_T525S |
| 2281 | D149A_E151A_L421F_Y422G_T525S_S523A |
| 2282 | D149A_E151A_Y272A_C307V_L421F_Y422A_C520A_T525S |
| 2283 | D149A_E151A_L421Y_Y422G_A496L |

FIG. 36B

Table 8: Wild type RMF 90817 = SEQ ID NO:2215

| SEQ# | Mutations based on SEQ ID NO:2215 |
|---|---|
| 2284 | Y11F_D149A_E151A_Y272A_C307A_L421F_Y422G_C520A_T525S |
| 2285 | D149A_E151A_C307A_L421F_Y422A_T525S |
| 2286 | D149A_E151A_L421F_Y422A_P423G_A496S |
| 2287 | Y11F_D149A_E151A_C307V_L421Y_Y422G_C520A_T525S |
| 2288 | D149A_E151A_Y272A_C307A_L421Y_Y422G_C520A_T525S |
| 2289 | D149A_E151A_L421F_Y422G_A496S |
| 2290 | D149A_E151A_L421F_Y422A_T525A |
| 2291 | D149A_E151A_L421Y_Y422G_A496V |
| 2292 | D149A_E151A_C307A_L421F_Y422A_C520A_T525S |
| 2293 | D149A_E151A_L421F_Y422G_T525S |
| 2294 | D149A_E151A_L421S_Y422A_P423A_T525A |
| 2295 | Y11F_D149A_E151A_L421F_Y422A_P423G |
| 2296 | D149A_E151A_L421Y_Y422A_A496L |
| 2297 | D149A_E151A_L421F_Y422A_P423G_A496T |
| 2298 | D149A_E151A_L421A_Y422A_A496T |
| 2299 | Y11F_D149A_E151A_L421Y_Y422A |
| 2300 | Y11F_D149A_E151A_Y272A_C307V_L421Y_Y422G_C520A_T525S |
| 2301 | D149A_E151A_L421F_Y422G_A496L |
| 2302 | D149A_E151A_L421S_Y422A_P423A_A496L |
| 2303 | D149A_E151A_L421A_Y422A_A496V |
| 2304 | D149A_E151A_C307A_L421F_Y422G_C520A_T525S |
| 2305 | D149A_E151A_C307V_L421F_Y422A_T525S |
| 2306 | D149A_E151A_L421A_Y422A_A496S |
| 2307 | Y11F_D149A_E151A_C307V_L421F_Y422G_C520A_T525S |

FIG. 36C

Table 8: Wild type RMF 90817 = SEQ ID NO:2215

| SEQ# | Mutations based on SEQ ID NO:2215 |
|---|---|
| 2308 | D149A_E151A_L421S_Y422A_A496V |
| 2309 | D149A_E151A_L421F_Y422A_T525S_S523A |
| 2310 | Y11F_D149A_E151A_C307V_L421F_Y422G_T525S |
| 2311 | D149A_E151A_L421A_Y422A_P423G_A496L |
| 2312 | D149A_E151A_L421Y_Y422A_A496V |
| 2313 | D149A_E151A_L421S_Y422A_P423A_A496T |
| 2314 | Y11F_D149A_E151A_Y272A_C307V_L421F_Y422A_C520A_T525S |
| 2315 | D149A_E151A_Y272A_C307V_L421F_Y422G_C520A_T525S |
| 2316 | D149A_E151A_Y272A_L421Y_Y422G_T525S |
| 2317 | D149A_E151A_L421S_Y422A_P423A_A496V |
| 2318 | Y11F_D149A_E151A_Y272A_C307V_L421Y_Y422G_T525S |
| 2319 | D149A_E151A_C307V_L421Y_Y422G_C520A_T525S |
| 2320 | Y11F_D149A_E151A_C307A_L421Y_Y422G_C520A_T525S |
| 2321 | D149A_E151A_L421F_Y422A_A496T |
| 2322 | D149A_E151A_L421F_Y422A_P423G_T525S_S523A |
| 2323 | D149A_E151A_L421Y_Y422G_T525S_S523A |
| 2324 | D149A_E151A_L421F_Y422A_P423A_T525S |
| 2325 | D149A_E151A_Y272A_C307V_L421F_Y422A_T525S |
| 2326 | D149A_E151A_L421F_Y422A_A496V |
| 2327 | Y11F_D149A_E151A_C307V_L421F_Y422A_T525S |
| 2328 | D149A_E151A_L421Y_Y422A_A496S |
| 2329 | D149A_E151A_C307A_L421Y_Y422G_C520A_T525S |
| 2330 | D149A_E151A_L421Y_Y422A_T525S |

FIG. 36D

Table 8: Wild type RMF 90817 = SEQ ID NO:2215

| SEQ# | Mutations based on SEQ ID NO:2215 |
|---|---|
| 2331 | Y11F_D149A_E151A_L421Y_Y422A_P423G |
| 2332 | D149A_E151A_L421F_Y422A_P423A_A496L |
| 2333 | Y11F_D149A_E151A_Y272A_C307V_L421F_Y422A_T525S |
| 2334 | Y11F_D149A_E151A_Y272A_C307A_L421F_Y422G_T525S |
| 2335 | D149A_E151A_L421S_Y422A_P423A_T525S |
| 2336 | Y11F_D149A_E151A_C307A_L421F_Y422A_T525S |
| 2337 | D149A_E151A_L421S_Y422A_A496L |
| 2338 | Y11F_D149A_E151A_L421F_Y422G |
| 2339 | D149A_E151A_C307A_L421F_Y422G_T525S |
| 2340 | Y11F_D149A_E151A_Y272A_C307A_L421Y_Y422G_C520A_T525S |
| 2341 | D149A_E151A_L421A_Y422A_P423G_T525S_S523A |
| 2342 | D149A_E151A_L421A_Y422A_P423G_A496T |
| 2343 | D149A_E151A_L421A_Y422A_P423G_A496S |
| 2344 | Y11F_D149A_E151A_Y272A_C307A_L421F_Y422A_C520A_T525S |
| 2345 | Y11F_D149A_E151A_Y272A_C307A_L421F_Y422A_T525S |
| 2346 | D149A_E151A_Y272A_C307A_L421F_Y422G_C520A_T525S |
| 2347 | Y11F_D149A_E151A_Y272A_L421Y_Y422G_T525S |
| 2348 | Y11F_D149A_E151A_C307V_L421Y_Y422G_T525S |
| 2349 | D149A_E151A_L421Y_Y422G_T525A |
| 2350 | D149A_E151A_L421F_Y422A_P423G_T525A |
| 2351 | D149A_E151A_L421A_Y422A_P423G_T525S |
| 2352 | D149A_E151A_L421F_Y422A_P423A_A496S |
| 2353 | Y11F_D149A_E151A_L421Y_Y422A |

FIG. 36E

Table 8: Wild type RMF 90817 = SEQ ID NO:2215

| SEQ# | Mutations based on SEQ ID NO:2215 |
|---|---|
| 2354 | Y11F_D149A_E151A_L421A_Y422A_P423G |
| 2355 | Y11F_D149A_E151A_L421F_Y422A_P423A |
| 2356 | Y11F_D149A_E151A_C307A_L421F_Y422A_C520A_T525S |
| 2357 | D149A_E151A_L421F_Y422A_P423A_T525S_S523A |
| 2358 | D149A_E151A_Y272A_C307V_L421Y_Y422G_T525S |
| 2359 | D149A_E151A_C307A_L421Y_Y422G_T525S |
| 2360 | Y11F_D149A_E151A_Y272A_C307V_L421F_Y422G_C520A_T525S |
| 2361 | D149A_E151A_L421S_Y422A_T525S_S523A |
| 2362 | D149A_E151A_L421F_Y422A_A496L |
| 2363 | D149A_E151A_L421F_Y422A_P423A_A496T |
| 2364 | D149A_E151A_L421Y_Y422G_A496T |
| 2365 | Y11F_D149A_E151A_C307A_L421F_Y422G_T525S |
| 2366 | D149A_E151A_L421F_Y422A_A496S |

FIG. 36F

Table 9: Wild type MBC 7218772 = SEQ ID NO:2367

| SEQ# | Mutations based on SEQ ID NO:2367 | Incorp'n |
|---|---|---|
| 2368 | D173A_E175A_L451F_Y452G | + |
| 2369 | D173A_E175A_L451F_Y452A_P453G | + |
| 2370 | D173A_E175A_L451S_Y452A_P453G | + |
| 2371 | D173A_E175A_L451S_Y452A | 0 |
| 2372 | D173A_E175A_L451S_Y452G_P453A | 0 |
| 2373 | D173A_E175A_L451Y_Y452G_P453A | 0 |
| 2374 | D173A_E175A_L451Y_Y452A_P453G | 0 |
| 2375 | D173A_E175A_L451F_Y452G_P453A | 0 |
| 2376 | D173A_E175A_L451A_Y452A_P453A | 0 |
| 2377 | D173A_E175A_L451S_Y452G | 0 |
| 2378 | D173A_E175A_L451A_Y452A_P453G | + |
| 2379 | D173A_E175A_L451A_Y452G | 0 |
| 2380 | D173A_E175A_L451A_Y452G_P453A | 0 |
| 2381 | D173A_E175A_L451Y_Y452A | + |
| 2382 | D173A_E175A_L451S_Y452A_P453A | + |
| 2383 | D173A_E175A_L451A_Y452A | + |
| 2384 | D173A_E175A_L451Y_Y452A_P453A | + |
| 2385 | D173A_E175A_L451Y_Y452G | 0 |
| 2386 | D173A_E175A_L451F_Y452A | 0 |
| 2387 | D173A_E175A_L451F_Y452A_P453A | + |

FIG. 37

Table 10: Wild type MBC 7218772 = SEQ ID NO:2367

| SEQ# | Mutations based on SEQ ID NO:2367 |
|---|---|
| 2388 | D173A_E175A_L451Y_Y452A_T560S |
| 2389 | D173A_E175A_Y452A_C468A |
| 2390 | D173A_E175A_L451Y_Y452A_T560A |
| 2391 | D173A_E175A_L451Y_Y452A_T560S_S561A |
| 2392 | I10F_D173A_E175A_L451S_Y452A_P453A |

FIG. 38

Table 11: Wild type WP 175059460 = SEQ ID NO:2393

| SEQ# | Mutations based on SEQ ID NO:2393 |
|---|---|
| 2394 | D141A_E143A_Y412A |
| 2395 | D141A_E143A_I228V_L411A_Y412A_P413A_G441S_K443R_G710S_R712K_A770T |
| 2396 | D141A_E143A_I228V_L411S_Y412A_G441S_K443R_I524H_G710S_R712K_A770T |
| 2397 | D141A_E143A_I228V_L411A_Y412A_P413A_G441S_K443R_I524H_G710S_R712K_A770T |
| 2398 | D141A_E143A_I228V_L411S_Y412G_G441S_K443R_I524H_G710S_R712K_A770T |
| 2399 | D141A_E143A_I228V_L411S_Y412A_P413G_G441S_K443R_G710S_R712K_A770T |
| 2400 | D141A_E143A_I228V_L411S_Y412A_G441S_K443R_A488S_G710S_R712K_A770T |
| 2401 | D141A_E143A_I228V_L411S_Y412G_G441S_K443R_G710S_R712K_A770T |
| 2402 | D141A_E143A_I228V_L411A_Y412A_P413A_G441S_K443R_A488S_G710S_R712K_A770T |
| 2403 | D141A_E143A_I228V_L411S_Y412A_P413G_G441S_K443R_A488S_G710S_R712K_A770T |
| 2404 | D141A_E143A_I228V_L411S_Y412A_G441S_K443R_G710S_R712K_A770T |
| 2405 | D141A_E143A_I228V_L411S_Y412G_G441S_K443R_A488S_G710S_R712K_A770T |
| 2406 | D141A_E143A_I228V_L411S_Y412A_P413G_G441S_K443R_I524H_G710S_R712K_A770T |
| 2407 | D141A_E143A_I228V_L411S_Y412A_G441S_K443R_A488S_K510L_I524H_G710S_R712K_A770T |

FIG. 39A

Table 11: Wild type WP 175059460 = SEQ ID NO:2393

| SEQ# | Mutations based on SEQ ID NO:2393 | Incorp'n |
|---|---|---|
| 2511 | D141A_E143A_L411A_Y412A_P413A | + + |
| 2512 | D141A_E143A_L411S_Y412A_P413G | + + |
| 2513 | D141A_E143A_L411S_Y412A | + + |
| 2514 | D141A_E143A_L411S_Y412G | + + |
| 2515 | D141A_E143A_L411A_Y412A_P413A_A488S | + + |
| 2516 | D141A_E143A_L411S_Y412A_P413G_A488S | + + + |
| 2517 | D141A_E143A_L411S_Y412A_A488S | + + + |
| 2518 | D141A_E143A_L411S_Y412G_A488S | + + |
| 2519 | D141A_E143A_L411A_Y412A_P413A_I524H | + |
| 2520 | D141A_E143A_L411S_Y412A_P413G_I524H | + |
| 2521 | D141A_E143A_L411S_Y412A_I524H | + + |
| 2522 | D141A_E143A_L411S_Y412G_I524H | + |
| 2523 | D141A_E143A_L411S_Y412A_A488S_K510L_I524H | + + + |

FIG. 39B

Table 12: Wild type KUO 42443 = SEQ ID NO:2408

| SEQ# | Mutations based on SEQ ID NO:2408 | Incorp'n |
|---|---|---|
| 2409 | D170A_E172A_L448A_Y449A_P450G | 0 |
| 2410 | D170A_E172A_L448F_Y449A | + |
| 2411 | D170A_E172A_L448Y_Y449A | + |
| 2412 | D170A_E172A_L448Y_Y449A_P450G | + |
| 2413 | D170A_E172A_L448S_Y449G_P450A | 0 |
| 2414 | D170A_E172A_L448A_Y449G_P450A | 0 |
| 2415 | D170A_E172A_L448S_Y449G | 0 |
| 2416 | D170A_E172A_L448A_Y449A_P450A | 0 |
| 2417 | D170A_E172A_L448A_Y449G | 0 |
| 2418 | D170A_E172A_L448Y_Y449A_P450A | 0 |
| 2419 | D170A_E172A_L448F_Y449G | 0 |
| 2420 | D170A_E172A_L448F_Y449G_P450A | 0 |
| 2421 | D170A_E172A_L448F_Y449A_P450A | 0 |
| 2422 | D170A_E172A_L448F_Y449A_P450G | + |
| 2423 | D170A_E172A_L448Y_Y449G_P450A | 0 |
| 2424 | D170A_E172A_L448Y_Y449G | 0 |

FIG. 40

Table 13: Wild type KUO 42443 = SEQ ID NO:2408

| SEQ# | Mutations based on SEQ ID NO:2408 |
|---|---|
| 2425 | D170A_E172A_L448Y_Y449A_P450G_T557A |
| 2426 | D170A_E172A_L448S_Y449A_P450A |
| 2427 | Y7F_D170A_E172A_L448Y_Y449G_T557S |
| 2428 | D170A_E172A_L448S_Y449A_P450G |
| 2429 | D170A_E172A_Y449A |
| 2430 | Y7F_D170A_E172A_L448S_Y449A |
| 2431 | D170A_E172A_L448Y_Y449A_P450G_T557S |
| 2432 | D170A_E172A_L448S_Y449A |
| 2433 | D170A_E172A_L448Y_Y449G_T557S |
| 2434 | D170A_E172A_L448Y_Y449A_P450G_T557S_S558A |
| 2435 | D170A_E172A_L448A_Y449A |

FIG. 41

Table 14: Wild type NOZ 77387 = SEQ ID NO:2436

| SEQ# | Mutations based on SEQ ID NO:2436 |
|---|---|
| 2437 | Y10F_C41A_D161A_E163A_L432F_Y433A_P434G_C531A_T536S |
| 2438 | Y10F_C41A_D161A_E163A_L432Y_Y433A_C531A_T536S |
| 2439 | Y10F_C41A_D161A_E163A_L432F_Y433G_C531A_T536S |
| 2440 | C41A_D161A_E163A_L432F_Y433A_P434G_C531A_T536S |
| 2441 | Y10F_C41A_D161A_E163A_L432Y_Y433G_C531A_T536S |
| 2442 | Y10F_C41A_D161A_E163A_L432S_Y433A_C531A_T536S |
| 2443 | C41A_D161A_E163A_L432F_Y433A_C531A_T536S |
| 2444 | Y10F_C41A_D161A_E163A_L432Y_Y433G_C531A_T536S |
| 2445 | C41A_D161A_E163A_L432Y_Y433G_C531A_T536S |
| 2446 | C41A_D161A_E163A_L432Y_Y433A_C531A_T536S |
| 2447 | C41A_D161A_E163A_L432A_Y433A_P434A_C531A_T536S |
| 2448 | C41A_D161A_E163A_L432Y_Y433A_P434G_C531A_T536S |
| 2449 | Y10F_C41A_D161A_E163A_L432A_Y433A_P434A_C531A_T536S |
| 2450 | C41A_D161A_E163A_L432S_Y433A_C531A_T536S |
| 2451 | Y10F_C41A_D161A_E163A_L432Y_Y433A_P434G_C531A_T536S |
| 2452 | C41A_D161A_E163A_L432F_Y433G_C531A_T536S |
| 2453 | Y10F_C41A_D161A_E163A_L432F_Y433A_C531A_T536S |
| 2454 | Y10F_C41A_D161A_E163A_L432Y_Y433G_C531A_T536S |

FIG. 42

Table 15: Wild type Phi29 = SEQ ID NO:2455

| SEQ# | Mutations based on SEQ ID NO:2455 |
|---|---|
| 2456 | M97K |
| 2457 | M97R |
| 2458 | I93K |
| 2459 | I93R |
| 2460 | Y101K |
| 2461 | Y101R |
| 2462 | Q99K |
| 2463 | Q99R |
| 2464 | M102K |
| 2465 | M102R |
| 2466 | F128K |
| 2467 | F128R |
| 2468 | M188K |
| 2469 | M188R |
| 2470 | L195K |
| 2471 | L195R |
| 2472 | L253A |
| 2473 | L253S |
| 2474 | L253I |
| 2475 | L253F |
| 2476 | L253M |
| 2477 | Y254A |
| 2478 | Y254G |
| 2479 | Y254S |
| 2480 | P255S |
| 2481 | P255T |
| 2482 | P255A |
| 2483 | P255G |

FIG. 43A

Table 15: Wild type Phi29 = SEQ ID NO:2455

| SEQ# | Mutations based on SEQ ID NO:2455 |
|---|---|
| 2484 | L416K |
| 2485 | L416R |
| 2486 | N396K |
| 2487 | N396R |
| 2488 | V425K |
| 2489 | V425R |
| 2490 | D535K |
| 2491 | D535R |
| 2492 | Y500N |
| 2493 | Y500K |
| 2494 | Y500R |
| 2495 | P558S |
| 2496 | P558T |
| 2497 | P558K |
| 2498 | L381S |
| 2499 | L381V |
| 2500 | L381G |
| 2501 | L381A |

FIG. 43B

| | | |
|---|---|---|
| RLF89 | ------------MILDTDYITENGKPVIRIFKKEKGEFKIEYDRNFEPYIYALLEDDESI-EDIK | 52 |
| WP175 | ------------MILDTDYITKDGKPIIRIFKKENGEFKIELDPHFQPYIYALLKDDSAI-EEIK | 52 |
| MBC72 | --------MRGLLFDVDIAEEEERPNVRLFVKVASETVVAIDPQFEEYFYVVADHPAKTSKLIE | 56 |
| KUO42 | ---------MLLDVDYAEEEEKPSIRLFVKTGSEVLVAIDPDFEEYFYVVSDHPAKASKLIE | 53 |
| NOZ58 | MPRILKGFLIDADYETVEGRALIRLFLRGEEGSFVVYDDSFSPYFYALPGDEPERVKE-R | 59 |
| RMF90 | ----MARDLLLDIDYTVDEKAQVRLFLKD------KILFDPGFQPYFYVLAHDGAVE-E--- | 49 |
| NOZ77 | --------MDGFLLDVDYKTVDEKPVVRLFLRD----VIALDPSFRPYVYVACDDPRAVAGEIK | 52 |
| |                .:  : *         *  *:            * .   . | |
| RLF89 | KITGERHGKKVRIIRVEKVKKFLGEPIEVWKLVFEHPQDVPAIRDAIRSHPAVREIFEY | 112 |
| WP175 | AIKGERHGKTVRVLDAVKVRKFLGREVEVWKLIFEHPQDVPAMRDKIKEHPAVIDIYEY | 112 |
| MBC72 | KIELDEGGRPIRPKSVEMVRRTLLGNEVEAIRVSFHQPRDAAKLRHKIRELPGVKEIYEF | 116 |
| KUO42 | KVEVEEDGVSIRPKGVEIVKRTFLGNEVEAIKVSFYQAKDSSKLRHKIRELPGVREIYEF | 113 |
| NOZ58 | ILAS----GAAEAIQKVEIEEKRLFGTPRVALRITVSHPQDVPRIRERIRRVEGVDLLIEH | 116 |
| RMF90 | ------RLRDFGAVEAVQRRMLGREMRFFKLILSHPSEVPKIREEVRSIEGVEGIFEH | 101 |
| NOZ77 | DLEL------DGRRPVTGVEEMERGLLGRPRRFLKVYLGHPQQVPRVRDLLRRLPGVSAVLED | 109 |
| |               :              :*   ::      * .  *           . | |
| RLF89 | DIPFAKRYLIDKGLVPMEGG-----------EELKLLAFDIET | 144 |
| WP175 | DIPFAKRYLIDKGLIPMEGD-----------EELKLLAFDIET | 144 |
| MBC72 | DIPPARRYLIDRGLTPMAGIEFSGSIEVRDGVKTVVMDGPPKPAPVEETRLNIMSFDIEV | 176 |
| KUO42 | DIPPARRYLIDRGLTPMAGVEEDGRIEERQGIKTVILDSPPRPAQVEEPKLNIMSFDIEV | 173 |
| NOZ58 | DILFVRRYLIDRGIKPLTWLRLEVEERDGRALLRGV------EQLEEEPPELRVAAVDIEV | 171 |
| RMF90 | DILFARRYLIDKGLTPLNYAEYRAEQ----GFLKGI-----SSAGEGPESLRVMAFDIET | 152 |
| NOZ77 | DILFSRRYLIDKGLVPTAWVELQGRVEGSEFWEEV------RRAEGPLPRLKVMSFDIET | 164 |
| | * *   :*****::*:*    *                           *  :* ***. | |

FIG. 44A

| | | |
|---|---|---|
| RLF89 | FYHEGDEF-AEGEILMISYADESGA-KVITWKKI---DLPYVEVVSTEREAIKRFLQVLRE | 200 |
| WP175 | FYHEGDEF--GKGEIIMISYADEEEA-RVITWKNI---DLPYVDVVSNEREMIKRFVQVVKE | 200 |
| MBC72 | YNPTGSVRPDKDPIIMISLADNRGLRKVITWKNFDKKPEYVEVVGSEREMIKKFVELVKE | 236 |
| KUO42 | YNPTGSVRPDKDPIIMISLADNNGLRKVITWKNFEERSQEYVEVVGSEREMIKRFVDLVKE | 233 |
| NOZ58 | YNPKGAPRSSKDEIIMISVATSDGVEKVLTWRE-VQGLEQVEVLQDEKEMLLRFAELIKE | 230 |
| RMF90 | YNPKGAPRAEKDPVIMLSLSTNTGLRRLLTYKS-GEGLDFVELVEDEKALLHRFKELVNE | 211 |
| NOZ77 | YNPKGAPRGDQDPIIMVSMATSGGLRKVLSWKAPTAGLEFVETLEDEAAVLRRFEELVRQ | 224 |
| | *  ::  ::*:.  . :::::  :  : .*  ::   ..   :*    :. | |
| RLF89 | KDPDVLLTYNGDNFDFAYIKKRCEKLGLKFTIGRDG----SEPKIQRMGDRFAVEVKGRIHL | 258 |
| WP175 | KDPDVIITYNGDNFDLPLYLIKRAEKLGIRLVLGRDKENPEPKIQRMGDSFAVEIKGRIHF | 260 |
| MBC72 | RDVDILLGYNTDLFDLPYIRSRAKQLRVKLDLGRDG--SELVVRKRRFATASKIRGRVHV | 294 |
| KUO42 | RDVDILLGYNTDLFDLPYIRSRAKQLRVKLDLGRDG--SELVVRKRRFATASKIRGRIHV | 291 |
| NOZ58 | GDYDVIVGYNTDSEDFPYIRDRLKKLGISLPLGRLD--AELEVSRRGALPEARIRGRAHV | 288 |
| RMF90 | EGVEVLVGYNSDQEFDLPYLVARAKALGVELPLGQDG--SQPQIRKGRGLVESVVKGRPHV | 269 |
| NOZ77 | EDPDILVGYNTDNFDFPYLNQRLKALGIELALGRDG----SPHKTSTRMGMSETRMAGRPHM | 282 |
| | . :::  **  **::* : :::. *:. :.    . :..:. :. ** *   | |
| RLF89 | DLYPVVR------HTIRLPTYTLEAVYEAVFGKKKEKVYAEEIAEAWKSE-EGLKRVAQYS | 312 |
| WP175 | DLFPVVR------RTINLPTYTLEAVYEAVLGKTKSKLGAEEIAAIWETE-ESMKKLAQYS | 314 |
| MBC72 | DVFAMVDFLATIGSIRLIHYSLADVYRHYAGREKPDFEFSEMINAWERGGDAGRRFLEYS | 354 |
| KUO42 | DVFAMVDFLATIGSIKLIHYSLADVYRHLLGKEKPDFEFTEMVDAWEKGGDAGRKFLEYS | 351 |
| NOZ58 | DLYPIVR------RHVKLNSYVLESVVEELLGIKKEKLDGERLFTYWDEGGEKRALLARYA | 343 |
| RMF90 | DLYPIVR------RNVRLSSYVLENVVKEVLGREKEKIPHDAMCGYWDRGGRELQRFMAYS | 324 |
| NOZ77 | DLYPIVR------RSLRLPSYVLEDVVAEVLGEEKEKVPGERMGEIWDKGGEELDRFFRYS | 337 |
| | *  :.*  . :. *  . ::::. :  .  . *   . .   | |

FIG. 44B

```
RLF89   MEDARATYELGREFFPMEVELAKLIGQSVWDVSRSSTGNLVEWYLLRVAYERNELAPNKP    372
WP175   MEDARATYELGKEFFPMEAELAKLIGQSVWDVSRSSTGNLVEWYLLRVAYARNELAPNKP    374
MBC72   MSDADATLEVGSELLPLFLGLTRVVGQTLFDVQRMTPGQLVEWLLVAEAHRIGELVPPRP    414
KUO42   MSDADATLEVGLELIPLFLGLTRVVGQTLFDVQRMTPGQLVEWLLVAEAHRIGELVPGRP    411
NOZ58   LEDARVTLALAEKFLPLYCELSTIVGQSLNDVARMTSGQLVEWLLMRYATPRGELIPNHP    403
RMF90   MEDADVTLELAERFLPLYIELSRVVGLPLHDVARMTAGQLVEWLLIREAFARGEVVPNKG    384
NOZ77   LEDAEVTLRIGEKYLPLYIELSRLVGQSIHDVARMTAGQLVEWYLMREAFARGEVIPERP    397
        : *   :  :    *        :: ::    :      *  **:***    *  .

RLF89   GGEEYQRRMRSSYIGGYVKEPEKGLWESIAYLDFRSLYPSIIVTHNVSPDTLEK-ECKN-    430
WP175   DEEEYKRRLRTTYLGGYVKEPEKGLWENIIYLDFRSLYPSIIVTHNVSPDTLEKEGCEN-    433
MBC72   VGEEFEERAEGTFTGAYVMEPVKGLHEDLVVFDFRSLYPSIIVTHNIDPSTLNCRDCKPG    474
KUO42   VGEEYEERMEETFVGAYVMEPVKGLHENLVVFDFRSLYPSIIVTHNIDPSTLNCKDCKPG    471
NOZ58   AGEEYAARARATYAGGYVREPKRGLVEHIAVEDFRSLYPSIIVSHNIDPSTLIVGNCE--    461
RMF90   SGREYLARSEDTYAGGYVMEPVKGIVENIVVFDFRSLYPSIIVTHNIDPATLRPGR-G--    441
NOZ77   GGREFARRAGDTYEGGYVREPRKGLLEK---VFDFRSLYPSVIVTHNIDPSTIRPGP-G--  452
         :*:  *   .  *.***:* :.*: .   . :*********:* :**:**.:

RLF89   --YDVAPIVGYRFCKDFKGFIPSILEDLIETRQKVKRKMKAT--IDPIEKKMLDYRQRALKI    488
WP175   -YDIAPIVGYKFCKDFPGFIPSILGDLIAMRQEIKKKMKAT--IDPIEKKMLDYRQRAVKL    491
MBC72   EREQVPGLSYYFCKRRKGFIPAVLERVIEEERTKLKAELKKIGRETREYRALDARQWAMKI    534
KUO42   EREQVPGLEYYFCRRRKGFIPATLQRIIEERMKLKAELKREIKRELKRS-EG-DRRRTLSFAEKALKI  531
NOZ58   -ENRAPELEYCFSLEREGFIPAILKELIRRRAEIKKELIRRAEIKRELKRS-EG-DRRRTLSFAEKALKI  518
RMF90   -ENSPPELDYHFTTEEEGFIPSVLKRVLERRLSAKRRMKEA-RDPGEKRMLDISQRALKI    499
NOZ77   -ENQPPGIDYHFTTEKEGFIPALLKRLVARRAELKEEMKKA-RDPGERKMLDVQQQALKI    510
                 *    :* ***::*: :          .         *  : * * .:

FIG. 44C
```

| | | |
|---|---|---|
| RLF89 | LANSYYGYQGYPKARWYSKECAESVTAWGRHYIETTIKEA-EKEGFKVLYADTDGFFATI | 547 |
| WP175 | LANSYYGYMGYPKARWYSKECAESVTAWGRHYIEMTIKEIEEKFGFKVLYADTDGFYATI | 551 |
| MBC72 | VANSFYGMLGYPRARWYSKQCAESVTSFGRHYIHRTIEMA-REFGLEVVYGDTDSLHCKL | 593 |
| KUO42 | VANSFYGMLGYPRARWYSKECAESVTSFGRHYIHKTIDMA-REFGLEVVYGDTDSLHCKL | 590 |
| NOZ58 | LANSFYGYMGYPRARWYRRECAESVAAFARMYIKQVMRIAEEEFKLEVVYGDTDSLFVVI | 578 |
| RMF90 | IANSFYGYMGYPRARWYKKECAESVTSFARMYTKKVMAIAEEEYGFKVVYGDTDSLFIVV | 559 |
| NOZ77 | LANSFYGYMGYPRARWYRKECAESVTAFARDYIKKVMEVAEKEFGLEVVYGDTDSLFILV | 570 |
| | :***:::. **.:***::*:.* : :: :::.:.*:**:..: .: | |
| | | |
| RLF89 | PNEKPETIKSKAKKFLKHINEKLPGMLELEYEGFYLRGFFVTKKKYALIDEDGHITTRGL | 607 |
| WP175 | PGEKPEIIKKKAREFLNYINSKLPGLLELEYEGFYLRGFFVTKKKRYAVIDEEGRITTRGL | 611 |
| MBC72 | NGKTRE----EAMVFLRKVNESLPGIMELELEGFYPRGIFITKKRYAMVDDEGRMVVKGL | 649 |
| KUO42 | NGKTRE----EALAFLKKVNDSLPGIMELELEGFYPRGIFITKKRYAMIDDEGRMVVKGL | 646 |
| NOZ58 | PPEKRE----LAQKFLQKVNESMPGIIELEFEGFYRRGLFVTKKRYALLSEDGKMVVKGL | 634 |
| RMF90 | QPEEKE----RAMSFMEDVNRRLPGTVELEYDGFYPRGIFITKKRYALIDEKGNIVVKGL | 615 |
| NOZ77 | PGGKKE----RAFAFLEEVNRRLPGTIELEYEGFYRRGIFVTKKRYALIDEKDRIIVKGL | 626 |
| | * * :. :*: .* :::*: :* :..:* *:.: .: *..:* | |
| | | |
| RLF89 | EVVRRDWSEIAKETQAKVLEVILREGSIEKAAGIVKKVVEDLANYRVPVEKLIIHEQITR | 667 |
| WP175 | EVVRRDWSEIAKETQAKVLEAILKDGSVEKAVEIVRDVVEKIAKYRVPLEKLVIHEQITR | 671 |
| MBC72 | EFVRRDWAAIAKKTQEEVLRAILRDGSPKKAAEIIRKTTRDVYEGRVNLEDLIIYTQLKM | 709 |
| KUO42 | EFVRRDWAAIAKKTQEEVLKAILRDGSPEKAAEIIRKTTRDVYEGRVNLEDLIIYTQLKM | 706 |
| NOZ58 | EFVRRDWAPIARETQKEVLRILLEEADPEKAARLVRDVIERIRQRRVSLEDITIYTQLTK | 694 |
| RMF90 | ETVRRDWTRLSRDTQQKVLSVILREGDPKKAADIVKDTINRLKERRVDLEDITITYQLTK | 675 |
| NOZ77 | EFVRRDWAPIARDTQEKVLKALLKDASPEEAVRIVRKAMDDIRARRVSLEDLTIYTQLTK | 686 |
| | * *** : :.:: :::.. . . * *: ::*: *: *::: | |

FIG. 44D

```
RLF89  ELKDYKATGPHVAIAKRLQARGIKVKPGTIISYVVLKGSKKISDRVILFDEYDSSRHKYD  727
WP175  DLKDYKAIGPHVSIAKRLATRGIKVKPGTIISYLVLKGGGRISDRVILLTEYDPEKHKYD  731
MBC72  PIESYKAIGPHVVAAKRLRELGHEIEPGMMIAYIEVKGPGSISDRAVPVEDF--EGKEYD  767
KUO42  PIESYKAIGPHVVAAKRLRELGHEIEPGMMIAYVEVKGPGSISERAVPVEDE---KGREYD 764
NOZ58  RIKSYKSLEPHVVAAQKLKERGREVAPGMIIGYIITKGTKGISQRATPVEFA---RLEDYD 752
RMF90  GIGRYKNVGPHVKAAQKAIDRGREVNPGMAIGYIIKKGRGLISDRAEPVEDA--TIEDYD  733
NOZ77  K----------------------------------------------------------  687

RLF89  PDYYIHNQVLPAVLRILEAFGYKEKDLEYQRMKQTGLGAWLKMGKK----  773
WP175  PDYYIENQVLPAVLRILEAFGYRKEDLRYQSSKQTGLDAWLKR------  774
MBC72  PDYYVGHQILPAVMRIMEVLGYSEEDLKFEREKQIGLDRFMK------  809
KUO42  PDYYVGHQVLPAVMRIMEVLGYREIDLKFERQRQVGLDRFMK------  806
NOZ58  PEYYIDNQILPAIQRIFEAIGYTRDYLKEGI-TQTSLSRWF-------  792
RMF90  VDYYIENQVLPPVARIMEVLGYSKEHLKEEM-VQGSLQRWF-------  773
NOZ77  -----------------------------------------------  687
```

FIG. 44E

```
Bst        MKKKLVLIDGNSVAYRAFFALPLLHNDKGIHTNAVYGFTMMLNKILAEEQPTHLLVAFDA   60
RLF89      ------------------------------------MILDTDYITENGKPVIRIFKK    21
90N        ------------------------------------MILDTDYITENGKPVIRVFKK    21
Pfu        ------------------------------------MILDVDYITEEGKPVIRLFKK    21
Pabyssi    ------------------------------------MIIDADYITEDGKPIIRIFKK    21
                                                *:.    *:  .  ::**.

Bst        GKTTFRHETFQEYKGGRQQTPPELSEQFPLLRELLKAYRIPAYELDHYEADDIIGTLAAR  120
RLF89      EKGEFKIEYD--------------------------------------------------  31
90N        ENGEFKIEYD--------------------------------------------------  31
Pfu        ENGKFKIEHD--------------------------------------------------  31
Pabyssi    EKGEFKVEYD--------------------------------------------------  31
            : *:*::  *

Bst        AEQEGFEVKIISGDRDLTQLASRHVTVDITKKGITDIEPYTPETVREKYGLTPEQIVDLK  180
RLF89      -------------------------------RNFEPYIYALLEDD------ESIEDIK    52
90N        -------------------------------RTFEPYFYALLKDD------SAIEDVK    52
Pfu        -------------------------------RTFRPYIYIALLRDD------SKIEEVK   52
Pabyssi    -------------------------------RTFRPYIYALLKDD------SAIDEVK   52
                                          . :.**  *   .      * :: *

Bst        GLMGDKSDNIPGVPGIGEKTAVKLLKQFGTVENVLASI---DEVKGEKLKENLRQHRDLAL  238
RLF89      KITGERHGKKVRIIRVEK-VKKKFL----GEPIEVWKLVFEHPQDVPAIRDAIRSHPAVR-  107
90N        KVTAKRHGTVWKVKRAEK-VQKKFL----GRPIEVWKLYFNHPQDVPAIRDRIRAHPAVV-  107
Pfu        KITGERHGKIVRIVDVEK-VEKKFL----GKPITVWKLYEHPQDVPTIREKVREHPAVV-  107
Pabyssi    KITAERHGKIVRITEVEK-VQKKFL----GRPIEVWKLYLEHPQDVPAIREKIREHPAVV-  107
            :    :.   :: . :*  * :*:      .**.**:    **.*:::  :.

FIG. 45A
```

```
Bst      LSKQLASICRDAPVELSLDDIVYEGQDREKVIALFKELGFQSFLEKMAAPAAEGEKPLEE  298
RLF89    ------------EIFEYDIPF---------------A-KRYLIDKGLVPMEGGEEELKL  137
90N      ------------DIYEYDIPF---------------A-KRYLIDKGLIPAEGDEELTM  137
Pfu      ------------DIFEYDIPF---------------A-KRYLIDKGLIPMEGEEELKI  137
Pabyssi  ------------DIFEYDIPF---------------A-KRYLIDKGLTPMEGNEELTF  137
                       ::  *                  . :*   . :*.  .    *

Bst      MEFAIVDVITEEMLADKAALVVEVMEENYHDAPIVGIALVNEHGRFFMRPETALADSQFL  358
RLF89    LAFDIETFYHE-----------------------GDEFAEGEILMISYADESG-----------AKVI  171
90N      LAFDIETLYHE-----------------------GEEFGTGPILMISYADGSE-----------ARVI  171
Pfu      LAFDIETLYHE-----------------------GEEFGKGPIIMISYADENE-----------AKVI  171
Pabyssi  LAVDIETLYHE-----------------------GEEFGKGPIIMISYADEEG-----------AKVI  171
           * ****:***                      *.:*  * ::*****:..            *:*

Bst      AWLADETKKKSMFD--------------AKRAVVALWKGIELRGVAFDLLLAAYLLNPA  404
RLF89    TWKKIDLPYVEVVSTEREAIKRFLQVLREKDPDVLLTYN------GDNFDE------AYIKKRC  223
90N      TWKKIDLPYVDVVSTEKEMIKRFLRVVREKDPDVLITYN------GDNFDF------AYLKKRC  223
Pfu      TWKNIDLPYVEVVSSEREMIKRFLRIIREKDPDIIVTYN------GDSFDF------PYLAKRA  223
Pabyssi  TWKSIDLPYVEVVSSEREMIKRLVKVIREKPDVIITYN------GDNFDF------PYLLKRA  223
          *:   .        :              **:  .*            ***:      *  :.

Bst      QD--------------------AGDIAA----------VAKMKQYEAVRSDEAVY  429
RLF89    EKLGLKFTIGRDGSEPKIQRMGDRFAVEVKGRIHLDLYPVVRHTIRLPTYTLEAVYEAVF  283
90N      EELGIKFTLGRDGSEPKIQRMGDRFAVEVKGRIHFDLYPVIRRTINLPTYTLEAVYEAVF  283
Pfu      EKLGIKLTIGRDGSEPKMQRIGDMTAVEVKGRIHFDLYHVITRTINLPTYTLEAVYEAIF  283
Pabyssi  EKLGIKLPLGRDNSEPKMQRMGDSLAVEIKGRIHFDLFPVIRRTINLPTYTLEAVYEAIF  283
         :.                        .                 *    :  *   **::
```

FIG. 45B

```
Bst       GKGVKRSLPDEQTLAEHLVRKAAAIWALEQPFMDDLRNNEQDLLTKLEQPLAAILAEME  489
RLF89     GKKKEKVYAEE----------IAEAWKSEEGLKRVAQYSMED-----------------  315
90N       GKPKEKVYAEE----------IAQAWESGEGLERVARYSMED-----------------  315
Pfu       GKPKEKVYADE----------IAKAWESGENLERVAKYSMED-----------------  315
Pabyssi   GKSKEKVYAHE----------IAEAWETGKGLERVAKYSMED-----------------  315
            **  :       *         *   :       :*

Bst       FTGVNVDTKRLEQMGSELAEQLRAIEQRIYELAGQEFNINSPKQLGVILFEKLQLPVLKK  549
RLF89     -------AR------ATYELGREFFPMEVELAKLIGQSVWDVSRSSTGNLV--EWY--LLR-  359
90N       -------AK------VTYELGREFFPMEAQLSRLIGQSLWDVSRSSTGNLV--EWF--LLR-  359
Pfu       -------AK------ATYELGKEFLPMEIQLSRLVGQPLWDVSRSSTGNLV--EWF--LLR-  359
Pabyssi   -------AK------VTFELGKEFFPMEAQLARLVGQPVWDVSRSSTGNLV--EWF--LLR-  359
                  *       **:  :*:  :  : *  .  **:***** *: *

Bst       TKTGYSTSADVLEKLAPHHEIVENILHYRQLGKLQSTYIEGLLKVVRPDTGKVHTMFNQ--  608
RLF89     --VAYE------RNELAPNKPGGE-----EYQRRMRSSYIGGYIGGYVKE--PEKGLWESIAYLD  405
90N       --KAYK------RNELAPNKPDER-----ELARR-RGGYAGGYVKE--PERGLWDNIVYLD  404
Pfu       --KAYE------RNEVAPNKPSEE-----EYQRRLRESYTGGFVKE--PEKGLWENIVYLD  405
Pabyssi   --KAYE------RNELAPNKPDER-----EYERRLRESYEGGYVKE--PEKGLWEGIVSLD  405
             .         :*::****. .        . *    *   *    *::**: *  :

Bst       --------ALTQTGRLSSAEP---NLQNIPIRLEEGRKIRQ---AFVPSEPDWL------  648
RLF89     FRSLYPSIIVTHNVSPDTLEK-ECKNYDVAPIVGYRFCKDFKGFIPSILEDLIETRQKVK  464
90N       FRSLYPSIITHNVSPDTLNREGCKEYDVAPEVGHKFCKDFPGFIPSLLGDLLEERQKIK  464
Pfu       FRALYPSIITHNVSPDTLNLEGCKNYDIAPQVGHKFCKDIPGFIPSLLGHLLEERQKIK  465
Pabyssi   FRSLYPSIITHNVSPDTLNRENCKEYDVAPQVGHRFCKDFPGFIPSLLGNLLEERQKIK  465
               . *  :       .     .   *        *
```

FIG. 45C

```
Bst       ------------IFAADYSQIELRVLAHIADDNLIEAFQRDLDIHTKTAMDIFHVSEEEV    697
RLF89     RKMKATIDPIEKKMLDYRQRALKILANSYYGY-----QGYPKARWYSKECAESVTAWGRHYI    521
9oN       RKMKATVDPLEKKLLDYRQRAIKILANSFYGY-----YGYAKARWYCKECAESVTAWGREYI    521
Pfu       TKMKETQDPIEKILLDYRQKAIKILANSFYGY-----YGYAKARWYCKECAESVTAWGRKYI    522
Pabyssi   KRMKESKDPVEKKLLDYRQRAIKILANSYYGY-----YGYAKARWYCKECAESVTAWGRQYI    522
                      ::  * :::***:****        ****:***:***********: **
Bst       TANMRRQAKAVNFGIVYGISDYGLA--------QNLNITRKEAAEFIERYFASFPGVKQYMENI    753
RLF89     ETTIKEAE--KFGFKVLYADTDGFFATIPNEKPETIKSKAKKELKHINEKLPGMLE-------    575
9oN       EMVIRELEEKFGFKVLYADTDGLHATIPGADAETVKKKAKEEFLKYINPKLPGLLE-------    576
Pfu       ELVWKELEEKFGFKVLYIDTDGLYATIPGGESEEIKKALEFVKYINSKLPGLLE-------    577
Pabyssi   DLVRRELE-SRGFKVLYIDTDGLYATIPGAKHEEIKEKALKFVEYINSKLPGLLE-------    576
              : .  : ****:** :*:**: ****           *.:**. :..***::*
Bst       VQEAKQKGYVTTLLHRRRYLPDITSRNFNVRSFAERTAMNT--------PIQGSAADIIKKA    807
RLF89     ----------------------LEYEGFYLRGFFVTKKKYALIDEDGHITTRGLEVVRRD    613
9oN       ----------------------LEYEGFYRGFFVTKKKKYAVIDEEGKITTRGLEIVRRD    614
Pfu       ----------------------LEYEGFYKRGFFVTKKRYAVIDEEGKVITRGLEIVRRD    615
Pabyssi   ----------------------LEYEGFYARGFFVTKKKYALIDEEGKIVTRGLEIVRRD    614
                                 :  :.  :  :: ::  ::  :::  ..::    :
Bst       MIDLAARLKEEQLQARLLQVHDELILEAPKEEIERLCELVPEVMEQAVTLRVPL--------    862
RLF89     WSEIAKE------TQAKVLEVI------LR---EGSIEKAAGIVKKVVEDLANYRVPVEKLII    661
9oN       WSEIAKE------TQARVLEAI------LK---HGDVEEAVRIVKEVTEKLSKYEVPPEKLVI    662
Pfu       WSEIAKE------TQARVLETI------LK---HGDVEEAVRIVKEVIQKLANYEIPPEKLAI    663
Pabyssi   WSEIAKE------TQAKVLEAI------LK---HGNVDEAVKIVKEVTEKLSKYEIPPEKLVI    662
          :  *                ::       :        :  . ::::  :::    *  :
```

FIG. 45D

```
Bst      ---------KVDYHYGPTWYDAK---------------------------------------           876
RLF89    HEQITRELKDYKATGPHVAIAKRLQARGIKVKPGTIISYVVLKGSKKISDRVILFDEYDS              721
90N      HEQITRDLRDYKATGPHVAVAKRLAARGVKIRPGTVISYIVLKGSGRIGDRAIPADEFDP              722
Pfu      YEQITRPLHEYKAIGPHVAVAKKLAAKGVKIKPGMVIGYIKPGMVIGYIVLRGDPISNRAILAEEYDP        723
Pabyssi  YEQITRPLSEYKAIGPHVAVAKRLAAKGVKVKPGMVIGYIVLRGDPISKRAIAIEEFDP               722

Bst      ---------------------------------------------                              876
RLF89    SRHKYDPDYIHNQVLPAVLRILEAFGYKEKDLEYQRMKQTGLGAWLKMGKK--                      773
90N      TKHRYDAEYYIENQVLPAVERILKAFGYRKEDLRYQKTKQVGLGAWLKVKGKK                      775
Pfu      KKHKYDAEYYIENQVLPAVLRILEGFGYRKEDLRYQKTRQVGLTSWLNIKKS-                      775
Pabyssi  KKHKYDAEYYIENQVLPAVERILRAFGYRKEDLKYQKTKQVGLGAWLKF----                      771
```

FIG. 45E

```
Bst       MKKKLVLIDGNSVAYRAFFALPLLHNDKGIHTNAVYGFTMMLNKILAEEQPTHLLVAFDA     60
NOZ58     --------------------------MPRILKGFLIDADYETVEGR---ALIRLFLR       28
9oN       ----------------------------------MILDTDYITENGK--PVIRVEKK       21
Pfu       ----------------------------------MILDVDYITEEGK--PVIRLFKK       21
Pabyssi   ----------------------------------MIIDADYITEDGK--PIIRIFKK       21
                                            ::  ::   *:      *

Bst       GKTTFRH---ETFQEYKGGRQQTPPELSEQFPLLRELLKAYRIPAYELDHYEADDIGTL    117
NOZ58     GEEGSFVVYDDSFSPYF---------------------YALP----------------     49
9oN       ENGEFKIEYDRTFEPYF---------------------YALL----------------     42
Pfu       ENGKFKIEHDRTFRPYI---------------------YALL----------------     42
Pabyssi   EKGEFKVEYDRTFRPYI---------------------YALL----------------     42
            .:  *                                *  *

Bst       AARAEQEGFEVKIISGDRDLTQLASRHVTVDITKKGITDIEPYTPETVREKYGLTPEQIV    177
NOZ58     --GDEPERVKERIL---ASGAAEAIQ--KVEIEEKRLF----GTPRVALRITVSHPQDVP     98
9oN       --KDDSAIEDVKKVTAKRHGTVVKVK--RAEKVQKKFL----GRPIEVWKLYFNHPQDVP     94
Pfu       --RDDSKIEEVKKITGERHGKIVRIV--DVEKVEKKFL----GKPITVWKLYLEHPQDVP     94
Pabyssi   --KDDSAIDEVKKITAERHGKIVRIT--EVEKVQKKFL----GRPIEVWKLYLEHPQDVP     94
           . .:    :                   ..*:: ::     *:* . :  :  *

Bst       DLKGLMGDKSDNIPGVPGIGEKTAVKLLKQF---G--TVENVLASIDEVKGEKLKENLR    231
NOZ58     RI------RERIRRVEGVDLILEHDI-LFVRRYLIDRGIKPLTWLRLEVEERDGRALLRGVE    153
9oN       AI------RDRIRAHPAVVDIYEYDI-PFAKRYLIDKGLIPAEG-----------------    131
Pfu       TI------REKVREHPAVVDIFEYDI-PFAKRYLIDKGLIPMEG-----------------    131
Pabyssi   AI------REKIREHPAVVDIFEYDI-PFAKRYLIDKGLTPMEG-----------------    131
            .      *::: :  .* *::    *
```

FIG. 46A

```
Bst      QHRDLALLSKQLASICRDAPVELSLDDIVYEGQDREKVIALFKELGFQSFLEKMAAPAAE    291
NOZ58    QL----------------------EEEPP-------------------------------    160
9oN      ---------------------------DE-------------------------------    133
Pfu      ---------------------------EE-------------------------------    133
Pabyssi  ---------------------------NE-------------------------------    133

Bst      GEKPLEEMEFAIVDVITEEMLADKAALVVEVMEENYHDAPIVGIALVNEHGRFFMRPETA    351
NOZ58    ------ELRVAAVDIEV----------YNPKGAPRSSKDEIIMISVATSDGVEKVLTWRE    204
9oN      ------ELTMLAFDIET----------LYHEGEE-FGTGPIIMISYADGS-EARVITWKK    175
Pfu      ------ELKILAFDIET----------LYHEGEE-FGKGPIIMISYADEN-EAKVITWKN    175
Pabyssi  ------ELTFLAVDIET----------LYHEGEE-FGKGPIIMISYADEE-GAKVITWKS    175
                *:  .  *:                  *  :*     *  ::*:    .*:**..

Bst      LADSQFLAWLADETKKKSMFDA------KRAVVALKWKGIELRGVAFDLLLAAYLLNPA    404
NOZ58    VQGLEQVEVLQDE-----KEMLLRFAELIKEGDYDVIVG------YNTDSFDE----PYIRDRL    253
9oN      I-DLPYVDVVSTE-----KEMIKRFLRVVREKDPDVLIT------YNGDNFDF----AYLKKRC    223
Pfu      I-DLPYVEVVSSE-----REMIKRFLRIIREKDPDIIVT------YNGDSFDF----PYLAKRA    223
Pabyssi  I-DLPYVEVVSSE-----REMIKRLVKVIREKDPDVIIT------YNGDNFDE----PYLLKRA    223
          :    .  :         ::::*   :: :   :            * * *:    ..: :

Bst      QD----------AGDIAA---------------------VAKMQYEAVRSDEAVY    429
NOZ58    KKLGISLPLGRLDAELEVSRRGALPEARIRGRAHVDLYPIVRRHVKLNSYVLESVVEELL    313
9oN      EELGIKFTLGRDGSEPKIQRMGDRFAVEVKGRIHFDLYPIVRIRRTINLPTYTLEAVYEAVF    283
Pfu      EKLGIKLTIGRDGSEPKMQRIGDMTAVEVKGRIHFDLYHVITRTINLPTYTLEAVYEAIF    283
Pabyssi  EKLGIKLPLGRDNSEPKMQRMGDSLAVEIKGRIHFDLFPVIRRTINLPTYTLEAVYEAIF    283
          :             *                   ::   *    .         *

FIG. 46B
```

```
Bst       GKGVKRSLPDEQTLAEHLVRKAAAIWALEQPFMDDLRNNEQDQLLTKLEQPLAAILAEME       489
NOZ58     GIKKEKLDGE-----------RLFTYWDEGGEKRALL----------AR----------YA     343
9oN       GKPKEKVYAE-----------EIAQAWESGE-GLERV----------AR----------YS     312
Pfu       GKPKEKVYAD-----------EIAKAWESGE-NLERV----------AK----------YS     312
Pabyssi   GKSKEKVYAH-----------EIAEAWETGK-GLERV----------AK----------YS     312
          *    ::               *                                     ::

Bst       FTGVNVDTKRLEQMGSELAEQLRAIEQRIYELAGQEFNINSPKQLGVILFEKLQLPVLKK       549
NOZ58     LED------ARVTLALAEKFLPLYCELSTIVGQSLNDVARMTSGQLV-------------       384
9oN       MED------AKVTYELGREFFPMEAQLSRLIGQSLWDVSRSSTGNLV-------------       353
Pfu       MED------AKATYELGKEFLPMEIQLSRLVGQPLWDVSRSSTGNLV-------------       353
Pabyssi   MED------AKVTFELGKEFFPMEAQLARLVGQPVWDVSRSSTGNLV-------------       353
          :         *  .  ..:: **  .  .. : *   *

Bst       TKTGYSTSADVLEKLAPHHEIVENILHYRQ-LGKLQSTYIEGLLKVVRPDTGKVHTMFNQ       608
NOZ58     ---------EWLLMRYATPRGELIPNHPAGEEYAARARATYAGGYVRE---PKRGLVEHIAVF     435
9oN       ---------EWFLLRKAYKRNELAPNKPDERELARR-RGGYAGGYVKE---PERGIWDNIVYL     403
Pfu       ---------EWFLLRKAYERNEVAPNKPSEEEYQRRLRESYTGGFVKE---PEKGLWENIVYL     404
Pabyssi   ---------EWFLLRKAYERNELAPNKPDEREYERRLRESYEGGYVKE---PEKGLWEGIVSL     404
                    *   ::   *  :                 *  ::    *    .

Bst       A-------LTQTGRLSSA---------EPNLQ-------NIPI----RLEEGRKI            636
NOZ58     DFRSLYPSIIVSHNIDPSTLIVGNCEEN-RAPELEYCFSLEREGFIPAILKELIRRRAEI       494
9oN       DFRSLYPSIITHNVSPDTLNREGCKEYDVAPEVGHKFCKDFPGFIPSLLGDLLEERQKI       463
Pfu       DFRALYPSIITHNVSPDTLNLEGCKNYDIAPQVGHKFCKDIPGFIPSLLGHLLEERQKI       464
Pabyssi   DFRSLYPSIITHNVSPDTLNRENCKEYDVAPQVGHRFCKDFPGFIPSLLGNLLEERQKI       464
                    *  **                        .:.  ..  :.*
```

FIG. 46C

```
Bst      RQAFVPSEPDWLIFAADYSQIELRVLAHIADDNLIEAFQRDLDIHTKTAMDIFHVSEEE         696
NOZ58    KRELKRSEGD-RRRTLSFAEKALKILANSFYGY----MGYPRARWYRRECAESVAAFARMY        550
9oN      KRKMKATVDPLEKKLLDYRQRAIKILANSFYGY----YGYAKARWYCKECAESVTAWGREY        520
Pfu      KTKMKETQDPIEKILLDYRQKAIKLLANSFYGY----YGYAKARWYCKECAESVTAWGRKY        521
Pabyssi  KKRMKESKDPVEKKLLDYRQRAIKILANSYYGY----YGYAKARWYCKECAESVTAWGRQY        521
          : :       : ::  :::::*:: ::* :         **********:******* *

Bst      VTANMRRQAKAVNFGIVYGISDYGLAQN------LNITRKEAAEFIERYFASFPGVKQYMEN       752
NOZ58    IKQVMRIAEEEKLEVVYGDTDSLFVVIPPEKRE---LAQKFLQKVNESMPGIIELEFE          606
9oN      IEMVIRELEEKFGFKVLYADTDGLHATIPGADAETVKKKAKEFLKYINPKLPGLLELEYE        580
Pfu      IELVWKELEEKFGFKVLYIDTDGLYATIPGGESEEIKKKALEFVKYINSKLPGLLELEYE        581
Pabyssi  IDLVRRELE-SRGFKVLYIDTDGLYATIPGAKHEEIKEKALKFVEYINSKLPGLLELEYE        580
          :      :      * :: :*   :                 * :::*: *::**  :

Bst      IVQEAKQKGYVTTLLHRRYLPDITSRNFNVRSFAERTAMNTPIQGSAADIIKKAMIDLA         812
NOZ58    ----GFYRRGLF-----VTKKRYALLSEDGKMV--------------VKGLEFVRRDWAPIA      645
9oN      ---GFYVRGFF-----VTKKKYAVIDEEGKIT---------------TRGLEIVRRDWSEIA      619
Pfu      ---GFYKRGFF-----VTKKRYAVIDEEGKVI---------------TRGLEIVRRDWSEIA      620
Pabyssi  ---GFYARGFF-----VTKKKYALIDEEGKIV---------------TRGLEIVRRDWSEIA      619
            *   :      ::  :: : :  :                     : :::: :   :*

Bst      ARLKEEQLQARLLLQVHDELILEAPKEEIERLCELVPEVMEQAVTLRVPL---------         862
NOZ58    RET------QKEVLR-----ILEE---ADPEKAARLVRDVIERIRQRRVSLEDITIYTQLT       693
9oN      KET------QARVLE-----AILKH---GDVEEAVRIVKEVTEKLSKYEVPPEKLVIHEQIT      667
Pfu      KET------QARVLE-----TILKH---GDVEEAVRIVKEVIQKLANYEIPPEKLAIYEQIT      668
Pabyssi  KET------QAKVLE-----AILKH---GNVDEAVKIVKEVTEKLSKYEIPPEKLVIYEQIT      667
          *    : :  *      :  ::  *:   *:  :* *: :*  :   :

FIG. 46D
```

```
Bst         ---KVDYHYGPTWYDAK---------------------------------------------          876
NOZ58       KRIKSYKSLEPHVVAAQKLKERGREVAPGMIIGYIITKGTKGISQRATPVEF---ARLEDY             751
9oN         RDLRDYKATGPHVAVAKRLAARGVKIRPGTVISYIVLKGSGRIGDRAIPADEFDPTKHRY             727
Pfu         RPLHEYKAIGPHVAVAKKLAAKGVKIKPGMVIGYIVLRGDGPISNRAILAEEYDPKKHKY             728
Pabyssi     RPLSEYKAIGPHVAVAKRLAAKGVKVKPGMVIGYIVLRGDGPISKRAIAIEEFDPKKHKY             727
                *                                 *  :

Bst         ------------------------------------------------------           876
NOZ58       DPEYYIDNQILPAIQRIFEAIGYTRDYLKEG-ITQTSLSRWF------------        792
9oN         DAEYYIENQVLPAVERILKAFGYRKEDLRYQKTKQVGLGAWLKVKGKK              775
Pfu         DAEYYIENQVLPAVLRILEGFGYRKEDLRYQKTRQVGLTSWLNIKKS-              775
Pabyssi     DAEYYIENQVLPAVERILRAFGYRKEDLKYQKTKQVGLGAWLKF---               771
```

FIG. 46E

```
Bst       MKKKLVLIDGNSVAYRAFFALPLLHNDKGIHTNAVYGFTMMLNK--ILAEEQPTHLLLVAF    58
RMF90     MA-----------------------------------------RDLLLDIDYVTVDEKAQV---RLF   23
9oN       -------------------------------------------MILDTDYITENGKPVI---RVF    19
Pfu       -------------------------------------------MILDVDYITEEGKPVI---RLF    19
Pabyssi   -------------------------------------------MIIDADYITEDGKPII---RIF    19
                                                      :: :  :   ::     *

Bst       DAGKTTFRHETFQEYKGGRQQTPPELSEQFPLLRELLKAYRIPAYELDHYEADDIIGTLA   118
RMF90     LKDK----ILF-------------D----------------------------------   31
9oN       KKENGEFKIEY-------------D----------------------------------   31
Pfu       KKENGKFKIEH-------------D----------------------------------   31
Pabyssi   KKEKGEFKVEY-------------D----------------------------------   31
           :                      :  :  ::

Bst       ARAEQEGFEVKIISGDRDLTQLASRHVTVDITKKGITDIEPYTPETVREKYGLTPEQIVD   178
RMF90     ----------------------------PGFQPYFYVLAHDG------AVEER------    50
9oN       ----------------------------RTFEPYFYALLKDD------SAIED------    50
Pfu       ----------------------------RTFRPYIYALLRDD------SKIEE------    50
Pabyssi   ----------------------------RTFRPYIYALLKDD------SAIDE------    50
                                       :  ** :                ::

Bst       LKGLMGDKSDNIPGVPGIGEKTAVKLLKQFGTVENVLASID---------EVKGEK     225
RMF90     LR------------------------DFGAVEAVQRRMLGREMRFFKLILSHPSEVPK    84
9oN       VKKVTAKRHGTVV-------------KVKRAEKVQKKFLGRPIEVWKLYFNHPQDVPA    95
Pfu       VKKITGERHGKIV-------------RIVDVEKVEKKFLGKPITVWKLYLEHPQDVPT    95
Pabyssi   VKKITAERHGKIV-------------RITEVEKVQKKFLGRPIEVWKLYLEHPQDVPA    95
          ::                         :  *          .        .

FIG. 47A
```

```
Bst       LKENLRQHRDLIALLSKQLASICRDAPVELSLDDIVYEGQDREKVIALFKELGFQSFLEKM   285
RMF90     IREEVRSIEGVEGIFEHDILFARRYLIDKGLTPLNYAE------YRA----EQGFLK-G    132
9oN       IRDRIRAHPAVVDIYEYDIPFAKRYLIDKGLIPA---------------------------  129
Pfu       IREKVREHPAVVDIFEYDIPFAKRYLIDKGLIPM---------------------------  129
Pabyssi   IREKIREHPAVVDIFEYDIPFAKRYLIDKGLTPM---------------------------  129
          :::..:.*    ::. :::.  ::: :.: :

Bst       AAPAAEGEKPLEEMEFAIVDVITEEMLADKAALVVEVMEENYHDAPIVGIALVNEHGRFF    345
RMF90     ISSAGEPESLRVMAFDIETYNPK----------------GAPRAEKDPVIMLSLSTNTGLRR  179
9oN       ------EGDEELTMLAFDIETLYHE--------------GEE-FGTGPILMISYADGSEAR-  169
Pfu       -------EGEEELKILAFDIETLYHE-------------GEE-FGKGPIIMISYADENEAK-  169
Pabyssi   -------EGNEELTFLAVDIETLYHE-------------GEE-FGKGPIIMISYADEEGAK-  169
          .      *:  : .:: ::              *   ::

Bst       MRPETALADSQFLAWLADETKKKSMFDA-------KRAVVALKWKGIELRGVAFDLLLAA    398
RMF90     LLTYKSGEGLDFVELVEDE-----KALLHREKELVNEEGVEVLVGY-----NSDQFDL----P  228
9oN       VITWK--KIDLPYVDVVSTE----KEMIKREFLRVVREKDPDVLITY------NGDNFDF----A  217
Pfu       VITWK--NIDLPYVEVVSSE----REMIKRELRIIREKDPDIIVTY------NGDSFDF----P  217
Pabyssi   VITWK--SIDLPYVEVVSSE----REMIKRLVKVIREKDPDVIITY------NGDNFDF----P  217
          ..      :  .  :: ..           . :   **:         .

Bst       YLLNPAQDAGD------------IAA-----------------VAKMKQYEAVR          423
RMF90     YLVARAKALGVELPLGQDGSQPQIRKGRGLVESVKGRPHVDLYPIVRRNVRLSSYVLEN       288
9oN       YLKKRCEELGIKFTLGRDGSEPKIQRMGDRFAVEVKGRIHFDLYPVIRRTINLPTYTLEA      277
Pfu       YLAKRAEKLGIKLTIGRDGSEPKMQRIGDMTAVEVKGRIHFDLYHVITRTINLPTYTLEA      277
Pabyssi   YLLKRAEKLGIKLPLGRDNSEPKMQRMGDSLAVEIKGRIHFDLFPVIRRTINLPTYTLEA      277
          **   .   *    :   :  : ::                *

FIG. 47B
```

```
Bst      SDEAVYGKGVKRSLPDEQTLAEHLVRKAAAIWALEQPFMDDLRNNEQDQLLTKLEQPLAA  483
RMF90    VVKEVLGREKEKIPHDA-------------MCGYWDRGGRELQRFMAY------------  323
9oN      VYEAVFGKPKEKVYAEE------------------IAQAWESG-EGLERVARY-------  311
Pfu      VYEAIFGKPKEKVYADE------------------IAKAWESG-ENLERVAKY-------  311
Pabyssi  VYEAIFGKSKEKVYAHE------------------IAEAWETG-KGLERVAKY-------  311
            :.*: ::                          *. : : . :: :*

Bst      ILAEMEFTGVNVDTKRLEQMGSELAEQLRAIEQRIYELAGQEFNINSPKQLGVIL-----  538
RMF90    ---SMED-------------ADVTLELAERFLPLYIELSRVVGLPLHDVARMTAGQLVEWLLI  370
9oN      ---SMED-------------AKVTYELGREFFPMEAQLSRLLIGQSLMDVSRSSTGNLVEWFLL  358
Pfu      ---SMED-------------AKATYELGKEFLPMEIQLSRLVGQPLMDVSRSSTGNLVEWFLL  358
Pabyssi  ---SMED-------------AKVTFELGKEFFPMEAQLARLVGQPVWDVSRSSTGNLVEWFLL  358
            .**             *  .:. ..  :: .  :      *

Bst      ---FEKLQLPV------LKKTKTGYSTSADVLEKLAPHHEIVENILHYRQLGKLQSTY  587
RMF90    REAFARGEVVPNKGSGREYLARSEDTYAGG---YVMEPVKGIVENIVVEDFRSLYPSII  426
9oN      RKAYKRNELAPNKPDERELARR-RGGYAGG----YVKEPERGLWDNIVYLDFRSLYPSII  413
Pfu      RKAYERNEVAPNKPSEEEYQRRLRESYTGG-----FVKEPEKGLWENIVYLDFRALYPSII  414
Pabyssi  RKAYERNELAPNKPDEREYERRLRESYEGG-----YVKEPEKGLWEGIVSLDFRSLYPSII  414
           .   :                           :  :    .  ..:.*:   .

Bst      IEGLLKVVRPDTGKVHTM---FNQALTQTGRLSSAEPNLQ-----N---IPIRLEEGRKIRQA  639
RMF90    VT---HNIDPATLRPGR--GENSPPELDYHFTEEEGFIPSVLKRVLERRLSAKRRMKEA  481
9oN      IT----HNVSPDTLNREGCKEYDVAPEVGHKFCKDFPGFIPSLLGDLLEERQKIKRKMKAT  470
Pfu      IT----HNVSPDTLNLEGCKNYDIAPQVGHKFCKDIPGFIPSLLGHLLEERQKIKTKMKET  471
Pabyssi  IT----HNVSPDTLNRENCKEYDVAPQVGHRFCKDFPGFIPSLLGNLLEERQKIKKRMKES  471
         :     ::  *                      .  :               *     ::

FIG. 47C
```

```
Bst      FVPSEPDWLIFAADYSQIELRVLAHIADDDNLIEAFQRDLDIHTKTAMDIFHVSEEEVTA  699
RMF90    RDPGEKR------MLDISQRALKIIANSFYG----YMGYPRARWYKKECAESVTSFARMYTKK  534
9oN      VDPLEKK------LLDYRQRAIKILANSFYG----YYGYAKARWYCKECAESVTAWGREYIEM  523
Pfu      QDPIEKI------LLDYRQKAIKLLANSFYG----YYGYAKARWYCKECAESVTAWGRKYIEL  524
Pabyssi  KDPVEKK------LLDYRQRAIKILANSYYG----YYGYAKARWYCKECAESVTAWGRQYIDL  524
                       *      :  :::*:                 *

Bst      NMRRQAKAVNFGIVYGISDYGLAQ------NLNITRKEAAEFIERYFASFPGVKQYMENIVQ  755
RMF90    VMAIAEEEYGFKVVYGDTDSLFIVVQPE---EKERAMSFMEDVNRRLPGTVELEYD------  587
9oN      VIRELEEKFGFKVLYADTDGLHATIPGADAETVKKKAKEFLKYINPKLPGLLELEYE-----  580
Pfu      VWKELEEKFGFKVLYIDTDGLYATIPGGESEIKKKALEFVKYINSKLPGLLELEYE------  581
Pabyssi  VRRELE-SRGFKVLYIDTDGLYATIPGAKHEEIKEKALKFVEYINSKLPGLLELEYE-----  580
               :  *  ::: :  **             . :    :  :.*:*:*  :*:

Bst      EAKQKGYVTTLLHRRYLPDITSRNFNVRSFAERTAMNTPIQGSAADIIKKAMIDLAARL    815
RMF90    GFYPRGIF------ITKKRYALIDEKGNIVV------------RGLETVRRDWTRLSRD--  628
9oN      GFYVRGFF------VTKKKYAVIDEEGKITT------------RGLEIVRRDWSEIAKE--  621
Pfu      GFYKRGFF------VTKKKYAVIDEEGKVIT------------RGLEIVRRDWSEIAKE--  622
Pabyssi  GFYARGFF------VTKKKYALIDEEGKIVI------------RGLEIVRRDWSEIAKE--  621
         ::  *         :::::**::***:                  :  :    :

Bst      KEEQLQARLLLQVHDELILEAPKEEIERLCELVPEVMEQAVTLRVP-----------L    862
RMF90    ----TQQKVLSVI----LR----EGDPKKAADIVKDTINRLKERRVDLEDITYTQLTKGI  677
9oN      ----TQARVLEAI----LK----HGDVEEAVRIVKEVTEKLSKYEVPPEKLVIHEQITRDL  670
Pfu      ----TQARVLETI----LK----HGDVEEAVRIVKEVTEKLSKYEIPPEKLAIYEQITRPL  671
Pabyssi  ----TQAKVLEAI----LK----HGNVDEAVKIVKEVTEKLSKYEIPPEKLVIYEQITRPL  670
             * ::* .:                                               ::
```

FIG. 47D

```
Bst       KVDYHYGPTWYDAK------------------------------------------------                  876
RMF90     GRYKNVGPHVKAAQKAIDRGREVNPGMAIGYIIKKGRGLISDRAEPVED---ATIEDYDVD                  735
9oN       RDYKATGPHVAVAKRLAARGVKIRPGTVISYIVLKGSGRIGDRAIPADEFDPTKHRYDAE                   730
Pfu       HEYKAIGPHVAVAKKLAAKGVKIKPGMVIGYIVLRGDGPISNRAILAEEYDPKKHKYDAE                   731
Pabyssi   SEYKAIGPHVAVAKRLAAKGVKVKPGMVIGYIVLRGDGPISKRAIAIEEFDPKKHKYDAE                   730
                **        *  :

Bst       --------------------------------------------                                    876
RMF90     YYIENQVLPPVARIMEVLGYSKEHLKEEM-VQGSLQRWF------                                   773
9oN       YYIENQVLPAVERILKAFGYRKEDLRYQKTKQVGLGAWLKVKGKK                                   775
Pfu       YYIENQVLPAVLRILEGFGYRKEDLRYQKTRQVGLTSWLNIKKS-                                   775
Pabyssi   YYIENQVLPAVERILRAFGYRKEDLKYQKTKQVGLGAWLKF----                                   771
```

FIG. 47E

```
Bst      MKKKLVLIDGNSVAYRAFFALPLLHNDKGIHTNAVYGFTMMLNKILAEEQPTHLLVAEDA    60
MBC72    ------------------------------MRGLLFDVDIAEEEERPNVRLFVKVA-     26
9oN      ------------------------------MILDTDYITENGKPVIRVFKKEN----     23
Pfu      ------------------------------MILDVDYITEEGKPVIRLFKKEN----     23
Pabyssi  ------------------------------MIIDADYITEDGKPIIRIFKKEK----     23
                                       * :  ::  .*: ::*:  .

Bst      GKTTFR--HETFQEYKGGRQQTPPELSEQFPLLRELLKAYRIPAYELDHYEADDIIGTLAA  119
MBC72    SETVVAIDPQFEEYFYVVADHPAKTS----------------------------------   52
9oN      GEFKIEYDRTFEPYFYIYALLKDDSAIE--------------------------------   49
Pfu      GKFKIEHDRTFRPYIYALLRDDSKIE----------------------------------   49
Pabyssi  GEFKVEYDRTFRPYIYALLKDDSAID----------------------------------   49
             *   . *  *: ::: :   .

Bst      RAEQEGFEVKIISGDRDLTQLASRHVTVDITKKGITDIEPYTPETVREKYGLTPEQIVDL   179
MBC72    ----------KLIEKIELDEGGR------PIRPKSVEMVRRTLLGNEVEAIRV--         89
9oN      ----------DVKKVTAKRHGT-------VVKVKRAEKVQKKFLGRPIEVWKL--         85
Pfu      ----------EVKKITGERHGK-------IVRIVDVEKKFLGKPITVWKL--           85
Pabyssi  ----------EVKKITAERHGK-------IVRITEVEKVQKKFLGRPIEVWKL--        85
                   ::   .          *       ** ::: . :..:

Bst      K------GLMGDKSDNIPGVPGIGEKTAVKLLKQFGTVENVLASIDEVKGEKLKENLRQ   232
MBC72    SFHQPRDAAKLRHKIRELPGVKEIYEFDIP-PARRYLI-D---RGLTPMAGIEFSGSIEV  144
9oN      YFNHPQDVPAIRDRIRAHPAVVDIYEYDIP-FAKRYLI-D----KGLIPAEGDEE----  134
Pfu      YLEHPQDVPTIREKVREHPAVVDIFEYDIP-FAKRYLI-D----KGLIPMEGEEE----  134
Pabyssi  YLEHPQDVPAIREKIREHPAVVDIFEYDIP-FAKRYLI-D----KGLTPMEGNEE----  134
                 ::: *  :   *   **  :*                *

FIG. 48A
```

```
Bst      HRDLALLSKQLASICRDAPVELSLDDIVYEGQDREKVIALFKELGFQSFLEKMAAPAAEG    292
MBC72    ------------------------------RDGVKTVVMDG-------------------    163
9oN      ------------------------------------------------------------    134
Pfu      ------------------------------------------------------------    134
Pabyssi  -----------------------------------------------PPKPAPVE----    134

Bst      EKPLEEMEFAIVDVITEEMLADKAALVVEVMEENYHDAPIVGIALVNEHGRFFMRPETAL    352
MBC72    ETRLNIMSFDIEVYNP-------------------TGSVRPDKDPIIMISLADNRG---    200
9oN      ----LTMLAFDIETLYH------------------EGE-EFGTGPILMISYADGSE---    167
Pfu      ----LKILAFDIETLYH------------------EGE-EFGKGPIIMISYADENE---    167
Pabyssi  ----LTFLAVDIETLYH------------------EGE-EFGKGPIIMISYADEEG---    167
          *  :  :***  :                       **: * :**** :

Bst      ADSQFLAWLADETKKKSMFDAKRAVVALKWKGIELRGVAF--------------------    392
MBC72    --------------------LRKVITWKNFDKKPEYVEVVGSEREMIKKFVELVKER--    237
9oN      --------------------ARVITWKKIDL----PYVDVVSTEKEMIKRFLRVVREK--    201
Pfu      --------------------AKVITWKNIDL----PYVEVVSSEREMIKRFLRIIREK--    201
Pabyssi  --------------------AKVITWKSIDL----PYVEVVSSEREMIKRLVKVIREK--    201
                              . :*.*:                   .

Bst      ---------------DLLLAAYLLNPAQDAGDI-----------A-------------    411
MBC72    DVDILLGYNTDLFDLPYIRSRAKQLRVKLDLGRDGSELVRKRRFATASKIRGRVHVDVF    297
9oN      DPDVLITYNGDNFDFAYLKKRCEELGIKFTLGRDGSEPKIQRMGDRFAVEVKGRIHFDLY    261
Pfu      DPDIVTYNGDSFDFPYLAKRAEKLGIKLTIGRDGSEPKMQRIGDMTAVEVKGRIHFDLY    261
Pabyssi  DPDVIITYNGDNFDFPYLLKRAEKLGIKLPLGRDNSEPKMQRMGDSLAVEIKGRIHFDLF    261
          *         *          :          *        .  :.
```

FIG. 48B

```
Bst       --------AVAKMKQYEAVRSDEAVYGKGVKRSLPDEQTLAEHLVRKAAAIWALEQPFM         462
MBC72     AMVDFLATIGSIRLIHYSLADVYRHYAEAVFGKPKEKVYA------SEMINAWERGGDAG         347
9oN       PVIR-----RTINLPTYTLEAVYEAVFGKPKEKVYA----------EEIAQAWESGEGL-         305
Pfu       HVIT-----RTINLPTYTLEAVYEAIFGKPKEKVYA----------DEIAKAWESGENL-         305
Pabyssi   PVIR-----RTINLPTYTLEAVYEAIFGKSKEKVYA----------HEIAEAWETGKGL-         305
                     .  *                                       *

Bst       DDLRNNEQDQLLTKLEQPLAAILAEMEFTGVNVDTKRLEQMGSELAEQLRAIEQRIYELA         522
MBC72     RRF---------------LEYSM----SDADATLEVGSE----LLPLFLGLTRVV              379
9oN       ERV---------------ARYSM----EDAKVTYELGRE----FFPMEAQLSRLI              337
Pfu       ERV---------------AKYSM----EDAKATYELGKE----FLPMEIQLSRLV              337
Pabyssi   ERV---------------AKYSM----EDAKVTFELGKE----FFPMEAQLARLV              337
             .                * ..       * .   * ..        .  . ..

Bst       GQEFNIN---SPKQLGVIL-FEK----LQL----PV----L-KKTKTGYSTSADVLEKLAP        566
MBC72     GQTLFDVQRMTPGQLVEWLLVAEAHRIGELVPPRPVGEEFEERAEGTFT-GAYVM----EP        435
9oN       GQSLWDVSRSSTGNLVEWFLLRKAYKRNELAPNKPDERELARR-RGGYA-GGYVK---EP        392
Pfu       GQPLWDVSRSSTGNLVEWFLLRKAYERNEVAPNKPSEEEYQRRLRESYT-GGFVK---EP        393
Pabyssi   GQPVWDVSRSSTGNLVEWFLLRKAYERNELAPNKPDEREYERRLRESYE-GGYVK---EP        393
          *     .          *    .                                   *

Bst       HHEIVENILHYRQLGKLQSTYIEGLLKVVRPDTGKVHTMFNQALTQTGRLSSAEPNLQNI        626
MBC72     VKGLHEDLVVFDFRSLYPSIIV---THNIDPSTLNCRDCKPG--------EREQV              479
9oN       ERGLWDNIVYLDFRSLYPSIII---THNVSPDTLNREGCKEY--------DVA                434
Pfu       EKGLWENIVYLDFRALYPSIII---THNVSPDTLNLEGCKNY--------DIA                435
Pabyssi   EKGLWEGIVSLDFRSLYPSIII---THNVSPDTLNRENCKEY--------DVA                435
           :  ..  . ::  : *.. ..     *  .* *                  ..
```

FIG. 48C

```
Bst       PIRLEEGRKIRQAFVPSEPDWLIFAADYSQIELRVLAHIADDNLIEAFQRDLDIHTKTA    686
MBC72     PGLSYYFCKRRKGFIPAVLERVIEERTKLKAELKKIGRETREYRALDARQWAMKIVANSF    539
9oN       PEVGHKFCKDFPGFIPSLLGDLLEERQKIKRKMKAT-VDPLEKKLLDYRQRAIKILANSE    493
Pfu       PQVGHKFCKDIPGFIPSLLGHLLEERQKIKTKMKET-QDPIEKILLDYRQKAIKLLANSE    494
Pabyssi   PQVGHRFCKDFPGFIPSLLGNLLEERQKIKKRMKES-KDPVEKKLLDYRQRAIKILANSY    494
              *          ::     :          : ::  *

Bst       MDIF--------------HVSEEEVTANMRRQAKAVNFGIVYGISDYGLAQN------L    725
MBC72     YGMLGYPRARWYSKQCAESVTSFGRHYIHRTI-EMAREFGLEVVYGDTDSLHCKLNGKTR    598
9oN       YGYYGYAKARWYCKECAESVTAWGREYIEMVIRELEEKFGFKVLYADTDGLHATIPGADA    553
Pfu       YGYYGYAKARWYCKECAESVTAWGRKYIELVWKELEEKFGFKVLYIDTDGLYATIPGGES    554
Pabyssi   YGYYGYAKARWYCKECAESVTAWGRQYIDLVRRELE-SRGFKVLYIDTDGLYATIPGAKH    553
           .                ::       .          ::    *:

Bst       NITRKEAAEFIERYFASFPGVKQYMENIVQEAKQKGYVTTLLHRRRYLPDITSRNFNVRS    785
MBC72     ------EEAMVFLRKVNESLPGIMELELE----GFYPRGIF---ITKKRYAMVDDEGRM-    644
9oN       ETVKKKAKEFLKYINPKLPGLIENPKLPGLLEENPE---GFYVRGFF---VTKKKYAVIDEEGKI----    603
Pfu       EEIKKKALEFVKYINSKLPGLIELEYE---GFYKRGFF----VTKKRYAVIDEEGKV----    604
Pabyssi   EEIKEKALKFVEYINSKLPGLIELELEYE---GFYARGFF---VTKKKYALIDEEGKI----    603
              .   :     ..:.*    .:         *     :* *  . .

Bst       FAERTAMNTPIQGSAADIIKKAMIDLAARLKEEIQARLLLQVHDELILEAPKEEIERL-    844
MBC72     -------VVKGLEFVRRDWAAIAKKTQEEVLRAILRDGSP-KKAAEIIRKTTRDVY    692
9oN       -------TTRGLEIVRRDWSEIAKETQARVLEAILKHGDV-EEAVRIVKEVTEKLS    651
Pfu       -------ITRGLEIVRRDWSEIAKETQARVLETIIKHGDV-EEAVRIVKEVIQKLA    652
Pabyssi   -------VTRGLEIVRRDWSEIAKETQAKVLEAILKHGNV-DEAVKIVKEVTEKLS    651
                  *    :     .   . ..

FIG. 48D
```

```
Bst       -CELVPEVMEQAVTLRVPLKVDYHYGPTWYDAK------------------------       876
MBC72     EGRVNLEDLIIYTQLKMPIESYKAIGPHVVAAKRLRELGHEIEPGMMIAYIEVKGPGSIS     752
9oN       KYEVPPEKLVIHEQITRDLRDYKATGPHVAVAKRLAARGVKIRPGTVISYIVLKGSGRIG     711
Pfu       NYEIPPEKLAIYEQITRPLHEYKAIGPHVAVAKKLAAKGVKIKPGMVIGYIVLRGDGPIS     712
Pabyssi   KYEIPPEKLVIYEQITRPLSEYKAIGPHVAVAKRLAAKGVKVKPGMVIGYIVLRGDGPIS     711
              :    :   *         ::       **              *   **

Bst       ------------------------------------------------------------     876
MBC72     DRAVPVEDFEG--KEYDPDYYVGHQILPAVMRIMEVLGYSEEDLKFEREKQIGLDRFMK-     809
9oN       DRAIPADEFDPTKHRYDAEYIENQVLPAVERILKAFGYRKEDLRYQKTKQVGLGAWLKV     771
Pfu       NRAILAEEYDPKKHKYDAEYYIENQVLPAVLRILEGFGYRKEDLRYQKTRQVGLTSWLNI    772
Pabyssi   KRAIAIEEFDPKKHKYDAEYYIENQVLPAVERILRAFGYRKEDLKYQKTKQVGLGAWLKF    771

Bst       ----                                                              876
MBC72     ----                                                              809
9oN       KGKK                                                              775
Pfu       KKS-                                                              775
Pabyssi   ----                                                              771
```

FIG. 48E

```
Bst      MKKKLVLIDGNSVAYRAFFALPLLHNDKGIHTNAVYGFTMMLNKILAEEQPTHLLVAFDA        60
WP175    ------------------------------------MILDTDYITKDGKPIIRIFKK        21
9oN      ------------------------------------MILDTDYITENGKPVIRVFKK        21
Pfu      ------------------------------------MILDVDYITEEGKPVIRLFKK        21
Pabyssi  ------------------------------------MIIDADYITEDGKPIIRIFKK        21
                                               *  :: :  .:: :: *

Bst      GKTTFRHETFQEYKGGRQQTPPELSEQFPLLRELLKAYRIPAYELDHYEADDIIGTLAAR       120
WP175    ENGEFKIELD--------------------------------------------------        31
9oN      ENGEFKIEYD--------------------------------------------------        31
Pfu      ENGKFKIEHD--------------------------------------------------        31
Pabyssi  EKGEFKVEYD--------------------------------------------------        31
         : *  * :

Bst      AEQEGFEVKIISGDRDLTQLASRHVTVDITKKGITDIEPYTPETVREKYGLTPEQIVDLK       180
WP175    ------------------------------------PHFQPYIYALLKDD-----SAIEEIK       52
9oN      ------------------------------------RTFEPYFYALLKDD-----SAIEDVK       52
Pfu      ------------------------------------RTFRPYIYALLRDD-----SKIEEVK       52
Pabyssi  ------------------------------------RTFRPYIYALLKDD-----SAIDEVK       52
                                             :.**      .         .  *

Bst      GLMGDKSDNIPGVPGIGEKTAVKLLKQF-GTVENVLASID--EVKGEKLKENLRQHRDLA       237
WP175    AIKGERHGKTVRVLD--------AVKVRKKFLGREVEVWKLIFEHPQDVPAMRDKIKEHPA---       105
9oN      KVTAKRHGTVVKVKR--------AEKVQKKFLGREVEVWKLIFEHPQDVPAIRDRIRAHPA---       105
Pfu      KITGERHGKIVRIVD--------VEKVEKKFLGKPITVWKLYFEHPQDVPTIREKVREHPA---       105
Pabyssi  KITAERHGKIVRITE--------VEKVQKKFLGRPIEVWKLYLEHPQDVPAIREKIREHPA---       105
         . :  * .             *      : *    *             *
```

FIG. 49A

```
Bst       LLSKQLASICRDAPVELSLDDIVYEGQDREKVIALFK-ELGF-QSFLEKMAAPAAEGEKP   295
WP175     ------------------------------------VIDIYEYDIPFAKRYLIDKGLIPMEGDEE   134
9oN       ------------------------------------VVDIYEYDIPFAKRYLIDKGLIPAEGDEE   134
Pfu       ------------------------------------VVDIFEYDIPFAKRYLIDKGLIPMEGEEE   134
Pabyssi   ------------------------------------VVDIFEYDIPFAKRYLIDKGLTPMEGNEE   134
                                              *  ::  :: *: :: ** ::

Bst       LEEMEFAIVDVITEEMLADKAALVVEVMEENYHDAPIVGIALVNEHGRFFMRPETALADS   355
WP175     LKLLAFDIETFYHE----------------------GDEFGKGEIIMISYADEE------E--   167
9oN       LTMLAFDIETLYHE----------------------GEEFGTGPILMISYADGS---------   167
Pfu       LKILAFDIETLYHE----------------------GEEFGKGPIIMISYADEN------E--   167
Pabyssi   LTFLAVDIETLYHE----------------------GEEFGKGPIIMISYADEE------G--   167
          *   * . :*    *                       ::  .  *  ::  :

Bst       QFLAWLADETKKKSMFDAKRAVVALKWKGIELRG--------------------------   389
WP175     ------------------------ARVITWKNIDLPYVDVVSNEREMIKRFVQVVKEKDPDVI   206
9oN       ------------------------ARVITWKKIDLPYVDVVSTEKEMIKRFLRVVREKDPDVL   206
Pfu       ------------------------ARVITWKNIDLPYVEVVSSEREMIKRFLRIIREKDPDII   206
Pabyssi   ------------------------AKVITWKSIDLPYVEVVSSEREMIKRLVKVIREKDPDVI   206
                                  . .:.**  *: ** **::* .  * .::

Bst       -----VAFDLLLAAYLLNPAQDA---------------------GDIAAV--------   413
WP175     ITYNGDNFDL---PYLIKRAEKLGIRLVLGRDKENPEPKIQRMGDSFAVEIKGRIHFDLF   263
9oN       ITYNGDNFDF---AYLKKRCEELGIKFTLGRDG--SEPKIQRMGDRFAVEVKGRIHFDLY   261
Pfu       VTYNGDSFDF---PYLAKRAEKLGIKLTIGRDG--SEPKMQRIGDMTAVEVKGRIHFDLY   261
Pabyssi   ITYNGDNFDF---PYLLKRAEKLGIKLPLGRDN--SEPKMQRMGDSLAVEIKGRIHFDLF   261
                                                 **    **    :::.

FIG. 49B
```

```
Bst       ------AKMKQYEAVRSDEAVYGKGVKRSLPDEQTLAEHLVRKAAAIWALEQPFMDDLRN          467
WP175     PVVRRTINLPTYTLEAVYEAVLGKTKSKLGA--------EEIAAIWETEESMKKLAQY             313
9oN       PVIRRTINLPTYTLEAVYEAVYEAVFGKPKEKVYA-----EEIAQAWESGEGLERVARY             311
Pfu       HVITRTINLPTYTLEAVYEAVYEAIFGKPKEKVYA-----DEIAKAWESGENLERVAKY             311
Pabyssi   PVIRRTINLPTYTLEAVYEAIFGKSKEKVYA---------HEIAEAWETGKGLERVAKY             311
              :  **:      **                          . *       :     :

Bst       NEQDQLLTKLEQPLAAILAEMEFTGVNVDTKRLEQMGSELAEQLRAIEQRIYELAGQEFN          527
WP175     SMED----------------------------AR----ATYELGKEFFPMEAELAKLIGQSVW        344
9oN       SMED----------------------------AK----VTYELGREFFPMEAQLSRLIGQSLW        342
Pfu       SMED----------------------------AK----ATYELGKEFLPMEIQLSRLVGQPLW        342
Pabyssi   SMED----------------------------AK----VTFELGKEFFPMEAQLARLVGQPVW        342
          .  :                            ::     **    *  ** . : .*  * *

Bst       INSPKQLGVILFEKLQLPVLKKTKTGYSTSADVLEKLAPHHEIVENILHYRQLGKLQSTY          587
WP175     DVSRSSTGNLV--EWY----LLR----VAYA------RNELAPNKPDEEE----YKRRLRTTY       387
9oN       DVSRSSTGNLV--EWF----LLR----KAYK------RNELAPNKPDERE----LARR-RGGY       384
Pfu       DVSRSSTGNLV--EWF----LLR----KAYE------RNEVAPNKPSEEE----YQRRLRESY       385
Pabyssi   DVSRSSTGNLV--EWF----LLR----KAYE------RNELAPNKPDERE----YERRLRESY       385
          .      *     **      *:     :        *::  ***         .  .  *

Bst       IEGLLKVVRPDTGKVHTMFNQ------ALTQTGRLSSAE--PNLQNIPIRLEEGRKKIR            637
WP175     LGGYVKE--PEKGLWENIIYLDFRSLYPSIIVTHNVSPDTLEKEGCENYDIAPIVGYKFC           445
9oN       AGGYVKE--PERGLWDNIVYLDFRSLYPSIIITHNVSPDTLNREGCKEYDVAPEVGHKFC           442
Pfu       TGGFVKE--PEKGLWENIVYLDFRALYPSIIITHNVSPDTLNLEGCKNYDVGHKFC                443
Pabyssi   EGGYVKE--PEKGLWEGIVSLDFRSLYPSIIITHNVSPDTLNRENCKEYDVAPQVGHRFC           443
            *      *  **     *          *                           ::

FIG. 49C
```

```
Bst       Q----AFVPSEPDWLI------------------------FAADYSQIELRVLAHIADDDNLIEAF              675
WP175     KDFPGFIPSILGDLIAMRQEIKKKMKATIDPIEKKMLDYRQRAVKLLANSYYGY-----MGY              502
9oN       KDFPGFIPSLLGDLLEERQKIKRKMKATVDPLEKKLLDYRQRAIKILANSFYGY-----YGY              499
Pfu       KDIPGFIPSLLGHLLEERQKIKTKMKETQDPIEKILLDYRQKAIKLLANSFYGY-----YGY              500
Pabyssi   KDFPGFIPSLLGNLLEERQKIKKRMKESKDPVEKKLLDYRQRAIKILANSYYGY-----YGY              500
           ..*:**         . . : . :*:::   * *::  .:. ** :::*::*:

Bst       QRDLDIHTKTAMDIFHVSEEEVTANMRRQAKAVNFGIVYGISDYG------LAQNLNITRKE              731
WP175     PKARWYSKECAESVTAWGRHYIEMTIKEIEEKFGFKVLYADTDGFYATIPGEKPEIIKKK                562
9oN       AKARWYCKECAESVTAWGREYIEMVIREIEEKFGFKVLYADTDGLHATIPGADAETVKKK                559
Pfu       AKARWYCKECAESVTAWGRKYIELVWKELEEKFGFKVLYIDTDGLYATIPGGESEEIKKK                560
Pabyssi   AKARWYCKECAESVTAWGRQYIDLVRRELE-SRGFKVLYIDTDGLYATIPGAKHEEIKEK                559
             *   ..* ::.  .. .:*:: :  . :  . ::*:.:*  :*:   .: * : .

Bst       AAEFIERYFASFPGVKQYMENIVQEEAKQKGYVTTLLHRRRYLPDITSRNFNVRSFAERTA               791
WP175     AREFLNYINSKLPKLPGLLEL---------------------------EYEGFYLRGFFVTKK             595
9oN       AKEFLKYINPKLPGLLEL------------------------------EYEGFYVRGFFVTKK             592
Pfu       ALEFVKYINSKLPGLLEL------------------------------EYEGFYKRGFFVTKK             593
Pabyssi   ALKFVEYINSKLPGLLEL------------------------------EYEGFYARGFFVTKK             592
          * :* : :.. :*.: *:**                                  :*.**   ..*

Bst       MNT------PIQGSAADIIKKAMIDLAARLKEEQLQARLLLQVHDELILEAPKEEIERLC               845
WP175     RYAVIDEEGRITTRGLEVVRRDWSEIAKE------TQAKVLEAI-----L---KDGSVEKAV             643
9oN       KYAVIDEEGKITTRGLEIVRRDWSEIAKE------TQARVLEAI-----L---KHGDVEEAV             640
Pfu       RYAVIDEEGKVITRGLEIVRRDWSEIAKE------TQARVLETI-----L---KHGDVEEAV             641
Pabyssi   KYALIDEEGKIVTRGLEIVRRDWSEIAKE------TQAKVLEAI-----L---KHGNVDEAV             640
                    . ::.::.  *::  .     ** ::** :     :

FIG. 49D
```

```
Bst       ELVPEVMEQAVTLRVPLK---------------VDYHYGPTWYDAK-----------------  876
WP175     EIVRDVVEKIAKYRVPLEKLVIHEQITRDLKDYKAISAKRLATRGIKVKPGTIIS           703
9oN       RIVKEVTEKLSKYEVPPEKLVIHEQITRDLRDYKATGPHVSIAKRLATRGIKVKPGTIIS      700
Pfu       RIVKEVIQKLANYEIPPEKLAIYEQITRPLHEYKAIGPHVAVAKKLAAKGVKIKPGMVIG      701
Pabyssi   KIVKEVTEKLSKYEIPPEKLVIYEQITRPLSEYKAIGPHVAVAKRLAAKGVKVKPGMVIG      700
          .:*..:*  ::*   .  .     .        **         **

Bst       --------------------------------------------------------------   876
WP175     YIVLKGGGRISDRVILLTEYDPEKHKYDPDYYIENQVLPAVLRILEAFGYRKEDLRYQSS     763
9oN       YIVLKGSGRIGDRAIPADEEDPTKHRYDPKKHKYDAEYYIENQVLPAVERILKAFGYRKEDLRYQKT 760
Pfu       YIVLRGDGPISNRAILAEEYDPKKKHKYDAEYYIENQVLPAVLRILEGFGYRKEDLRYQKT     761
Pabyssi   YIVLRGDGPISKRAIAIEEFDPKKHKYDAEYYIENQVLPAVERILRAFGYRKEDLKYQKT      760

Bst       -----------------   876
WP175     KQTGLDAWLKR------   774
9oN       KQVGLGAWLKVKGKK--   775
Pfu       RQVGLTSWLNIKKS---   775
Pabyssi   KQVGLGAWLKF------   771
```

FIG. 49E

```
Bst       MKKKLVLIDGNSVAYRAFFALPLLHNDKGIHTNAVYGFTMMLNKILAEEQPTHLLVAFDA    60
KUO42     ------------------------------------MLLDVDYAEEEEKPSIRLFVK      21
9oN       ------------------------------------MILDTDYITENGKPVIRVFKK      21
Pfu       ------------------------------------MILDVDYITEEGKPVIRLFKK      21
Pabyssi   ------------------------------------MIIDADYITEDGKPIIRIFKK      21
                                              *:. .  *:

Bst       GKTTFRH---ETFQEYKGGRQQTPPELSEQFPLLRELLKAYRIPAYELDHYEADDIIGTL   117
KUO42     TGSEVLVAIDPDFEEYFYVVSDHPAKASK-------------------------LIEK-    54
9oN       ENGEFKIEYDRTFEPYFYALLKDDSAI-E-------------------------DVKK-    53
Pfu       ENGKFKIEHDRTFRPYIYALIRDDSKI-E-------------------------EVKK-    53
Pabyssi   EKGEFKVEYDRTFRPYIYALLKDDSAI-D-------------------------EVKK-    53
                *.   *                                                 :.

Bst       AARAEQEGFEVKIISGDRDLTQLASRHVTVD---------------------ITKKGITDIEPY   160
KUO42     -VEVEEDGVSIRPKGVEIVKRTFLGNEVEAIKVSFYQAKDSSKLRHKIRELPGVREIYEF   113
9oN       -VTAKRHGTVVKVKRAEKVQKKFLGRPIEVWKLYFNHPQDVPAIRDRIRAHPAVVDIYEY   112
Pfu       -ITGERHGKIVRIVDVEKVEKKFLGKPITVWKLYLEHPQDVPTIREKVREHPAVVDIFEY   112
Pabyssi   -ITAERHGKIVRITEVEKVQKKFLGRPIEVWKLYLEHPQDVPAIREKIREHPAVVDIFEY   112
            ..  *                                             :: . :.

Bst       TPET---VREKYGLTPEQIVDLKGLMGDKSDNIPGVPGIGEKTAVKLLKQFGTVENVLAS   217
KUO42     DIPPARRYLIDRGLTPMAGVEFDGRIEERQG--------I-------------------   152
9oN       DIPFAKRYLIDKGLIPAEGDE---------------------------KTVILDS      133
Pfu       DIPFAKRYLIDKGLIPMEGEE--------------------------------         133
Pabyssi   DIPFAKRYLIDKGLTPMEGNE--------------------------------         133
             *  *  *** ** *                                       ::
```

FIG. 50A

```
Bst       IDEVKGEKLKENLRQHRDLALLSKQLASICRDAPVELSLDDIV---YEGQDR-EKVIALF   273
KUO42     P------------PRPAQVEEPKLNIMSFDIEVYNPTGSVRPDKDPIIMISLADNNGLRKVIT-W  204
9oN       ------------------ELTMLAFDIETLYHEGE-EFGTGPIIMISYADGSEA-RVIT-W  173
Pfu       ------------------ELKILAFDIETLYHEGE-EFGKGPIIMISYADENEA-KVIT-W  173
Pabyssi   ------------------ELTFLAVDIETLYHEGE-EFGKGPIIMISYADEEGA-KVIT-W  173
                            *  :::   ::         .       .  :*:*:  ::

Bst       KELG--FQSFLEKMAAPAAEGEKPLEEMEFAIVDVITEEMLADKAALVVEVMEENYHDAPI  332
KUO42     KNFERSQEYVEVV--------GSEREMIKRFVDLVKER----------DVD---        237
9oN       KKID---LPYVDVV-------STEKEMIKRFLRVVREK----------DPD---        204
Pfu       KNID---LPYVEVV-------SSEREMIKRFLRIIREK----------DPD---        204
Pabyssi   KSID---LPYVEVV-------SSEREMIKRLVKVIREK----------DPD---        204
          *.:    :  *:         .**:***:  :: **            *

Bst       VGIALVNEHGRFFMRPETALADSQFLAWLADETKKKSM------FDAKRAVVALKWK        383
KUO42     I-----LLGYNTDLFDL------PYIRSRAKQLKVKLDLGRDGSELVVRKRRFATASKIR   286
9oN       V-----LITYNGDNFDF------AYLKKRCEELGIKFTLGRDGSEPKIQRMGDRFAVEVK   253
Pfu       I-----IVTYNGDSFDF------PYLAKRAEKLGIKLTIGRDGSEPKMQRIGDMTAVEVK   253
Pabyssi   V-----IITYNGDNFDF------PYLLKRAEKLGIKLPLGRDNSEPKMQRMGDSLAVEIK   253
          .     : .   : *          *:::: : :  ::: *  .. :  : :.

Bst       GIELRGVAFDLLLAAYLLNPAQDAGDIAAVAKMKQYEAVRSDEAVYGKGVKRSLPDEQTL   443
KUO42     G-----RIHVDVFAMVDFLAT------IGSIKLIHYSLADVYRHLLGKEKPDFEFT---   331
9oN       G-----RIHFDLYPVIR---------RTINLPTYTLEAVYEAVFGKPKEKVYAE-----   293
Pfu       G-----RIHFDLYHVIT---------RTINLPTYTLEAVYEAIFGKPKEKVYAD-----   293
Pabyssi   G-----RIHFDLFPVIR---------RTINLPTYTLEAVYEAIFGKSKEKVYAH-----   293
          *       : .                 .  : :  .*:    *.  :: :
```

FIG. 50B

```
Bst      AEHLVRKAAAIWALEQPFMDDLRNNEQDQLLTKLEQPLAAILAEMEFTGVNVDTKRLEQM    503
KU042    ------------EMVDAWEKGDAGRKFLEY------SMS---------DADATLEV        361
9oN      ------------EIAQAWESGEGL-ERVARY------SME---------DAKVTYEL        322
Pfu      ------------EIAKAWESGENL-ERVAKY------SME---------DAKATYEL        322
Pabyssi  ------------EIAEAWETGKGL-ERVAKY------SME---------DAKVTFEL        322
                      :  .      *                        *  :  ::

Bst      GSELAEQLRAIEQRIYELAGQEFNIN----SPKQLGVIL-FEK-------LQLPVLK------  548
KU042    G-----LELLPLFLGLTRVVGQTLFDVQRMTPGQLVEWLLVAEAHRIGELVPGRPVGEEYE   417
9oN      G-----REFFPMEAQLSRLIGQSLWDVSRSSTGNLVEWFLLRKAYKRNELAPNKPDERELA   378
Pfu      G-----KEFLPMEIQLSRLVGQPLWDVSRSSTGNLVEWFLLRKAYERNEVAPNKPSEEEYQ   378
Pabyssi  G-----KEFFPMEAQLARLVGQPVWDVSRSSTGNLVEWFLLRKAYERNELAPNKPDEREYE   378
         *       :  ::  *:  :  **                   .:          ::

Bst      -KTKTGYSTSADVLEKLAPHHEIVENILHYRQLGKLQSTYIEGLLKVVRPDTGKVHTMFN    607
KU042    ERMEETFVG-AYV----MEPVKGLHENLVFDFRSLYPSIIV----THNIDPSTLNCKDCKP   470
9oN      RR-RGGYAG-GYV----KEPERGLWDNIVYLDFRSLYPSIII---THNVSPDTLNREGCKE   430
Pfu      RRLRESYTG-GFV----KEPEKGLWENIVYLDFRALYPSIII---THNVSPDTLNLEGCKN   431
Pabyssi  RRLRESYEG-GYV----KEPEKGLWEGIVSLDFRSLYPSIII---THNVSPDTLNRENCKE   431
           :   ..   :      *    .  : :::.*  ***::     .. . *:*    ..

Bst      QALTQTGRLSSAEPNLQNIPIRLEEGRKIRQAFVPSEPDWLIFAADYSQIELRVLAHIAD    667
KU042    GER------EQVPGLE----YYFCRRRKGFIPATLQRIIEERMKLKAELKKLVRGTK      517
9oN      YD-------VAPEVG-----HKFCKDFPGFIPSLLGDLLEERQKIKRKMKATV-DPL      474
Pfu      YD-------IAPQVG-----HKFCKDIPGFIPSLLGHLLEERQKIKTKMKETQ-DPI      475
Pabyssi  YD-------VAPQVG-----HRFCKDFPGFIPSLLGNLLEERQKIKKRMKESK-DPV      475
           .         .         * *.:  *:*: .   :.            .

FIG. 50C
```

```
Bst       DDNLIEAFQRDLDIHTKTAMDIFH----------------VSEEEVTANMRRQAKAVNF    710
KUO42     EYRALDARQWAMKIVANSFYGMLGYPRARWYSKECAESVTSFGRHYIHKTID-MAREFGL    576
9oN       EKKLLDYRQRAIKILANSFYGYYGYAKARWYCKECAESVTAWGREYIEMVIRELEEKFGF    534
Pfu       EKILLDYRQKAIKLLANSFYGYYGYAKARWYCKECAESVTAWGRKYIELVWKELEEKFGF    535
Pabyssi   EKKLLDYRQRAIKILANSYYGYYGYAKARWYCKECAESVTAWGRQYIDLVRRELE-SRGF    534
           ::  **     ::  ::: .    *   :*  .*:**** :  :..: : :*.    ..

Bst       GIVYGISDYGLAQN------LNITRKEAAEFIERYFASFPGVKQYMENIVQEAKQKGYVTTL    766
KUO42     EVVYGDTDSLHCKLNGKTR---EEALAFLKKVNDSLPGIMELELE---GFYPRGIF----    626
9oN       KVLYIDTDGLHATIPGADAETVKKKAKEFLKYINPKLPGLLELEYE---GFYVRGFF----    588
Pfu       KVLYIDTDGLYATIPGGESEEIKKKALEFVKYINSKLPGLLELEYE---GFYKRGFF----    589
Pabyssi   KVLYIDTDGLYATIPGAKHEEIKEKALKFVEYINSKLPGLLELEYE---GFYARGFF----    588
           ::* ::*.   .          ::: *  ::  .  **::*** :    *:

Bst       LHRRRYLPDITSRNFNVRSFAERTAMNTPIQGSAADIIKKAMIDLAARLKEEQLQARLLL    826
KUO42     ITKKRYAMIDDEGRM------------------VVKGLEFVRRDWAAIAKKTQEEVLKAILRD    671
9oN       VTKKKYAVIDEEGKI------------------TTRGLEIVRRDWSEIAKETQARVLEAILKH    633
Pfu       VTKKRYAVIDEEGKV------------------ITRGLEIVRRDWSEIAKETQARVLETILKH    634
Pabyssi   VTKKKYALIDEEGKI------------------VTRGLEIVRRDWSEIAKETQAKVLEAILKH    633
           :.::.** :*:*..                     .**:.***:   *: *:: * :: *

Bst       QVHDELILEAPKEEIERL--CELVPEVMEQAVTLRVPLKVDYHYGPTWYDAK--------    876
KUO42     G-SPEKAAEIIRKTTTRDVYEGRVNLEDLIIYTQLKMPIESYKAIGPHVVAAKRLRELGHE    730
9oN       G-DVEEAVRIVKEVTEKLSKYEVPPEKLVIHEQITRDLRDYKATGPHVVAKKLAARGVK    692
Pfu       G-DVEEAVRIVKEVIQKLANYEIPPEKLAIYEQITRPLHEYKAIGPHVVAKKLAAKGVK    693
Pabyssi   G-NVDEAVKIVKEVTEKLSKYEIPPEKLVIYEQITRPLSEYKAIGPHVVAVKRLAAKGVK    692
           .    : :  :.  ..    . :*::  ::  : : . .**  **  * :::. .

FIG. 50D
```

```
Bst        ------------------------------------------------------------
KU042      IEPGMMIAYVEVKGPGSISERAVPVEDFK---GREYDPDYYVGHQVLPAVMRIMEVLGYRE    876
9oN        IRPGTVISYIVLKGSGRIGDRAIPADEEDPTKHRYDAEYYIENQVLPAVERILKAFGYRK    788
Pfu        IKPGMVIGYIVLRGDGPISNRAILAEEYDPKKHKYDAEYYIENQVLPAVLRILEGFGYRK    752
Pabyssi    VKPGMVIGYIVLRGDGPISKRAIAIEEFDPKKHKYDAEYYIENQVLPAVERILRAFGYRK    753
                                                                          752

Bst        ------------------------
KU042      IDLKFEERQRQVGLDRFMK-----    876
9oN        EDLRYQKTRQVGLGAWLKVVGKK    806
Pfu        EDLRYQKTRQVGLTSWLNIKKS-    775
Pabyssi    EDLKYQKTKQVGLGAWLKF----    775
                                      771
```

FIG. 50E

```
Bst       MKKKLVLIDGNSVAYRAFFALPLLHNDKGIHTNAVYGFTMMLNKILAEEQPTHLLVAFDA    60
NOZ77     ------------------------------MDGFLLDVDYKTVDEKPVVRLFLRDV       26
9oN       ------------------------------MILDTDYITENGKPVIRVFKKEN          23
Pfu       ------------------------------MILDVDYITEEGKPVIRLFKKEN          23
Pabyssi   ------------------------------MIIDADYITEDGKPIIRIFKKEK          23
                                         * :  :: :  ::  *

Bst       GKTTFRH--ETFQEYKGGRQQTPPELSEQFPLLRELLKAYRIPAYELDHYEADDIIGTLAA   119
NOZ77     ----IALDPSFRPYVYVACDDPR--------------------AVAGEIKDLE-          55
9oN       GEFKIEYDRTFEPYFYALLKDDS--------------------AIEDV-KKVTA         56
Pfu       GKFKIEHDRTFRPYIYALLRDDS--------------------KIEEV-KKITG         56
Pabyssi   GEFKVEYDRTFRPYIYALLKDDS--------------------AIDEV-KKITA         56
             :  ::   *  :   .                         *:

Bst       RAEQEGFEVKIISGDRDLTQLASRHVTVDITKKGITDIEPYTPETVREKYGLTPEQIVDL   179
NOZ77     -------LDGRRPVTGV-----------EEMERGLL------GRPRRFLKVYLGHPQQVPRV  93
9oN       --KRHGTVVKRA----------------EKVQKKFL------GRPIEVWKLYFNHPQDVPAI  96
Pfu       --ERHGKIVRIVDV--------------EKVEKKFL------GKPITVWKLYLEHPQDVPTI  96
Pabyssi   --ERHGKIVRITEV--------------EKVQKKFL------GRPIEVWKLYLEHPQDVPAI  96
             :                         *   *        *:*  .  *   **  *  ..

Bst       KGLMGDKSDNIPGVPGIGEKTAVKLLKQFGTVENVLASIDEVKGEKLKENLRQHRDLALL   239
NOZ77     R----DLLRRLPGVSAVLEDDIL-FSRRY--------------------LI            119
9oN       R----DRIRAHPAVVDIYEYDIP-FAKRY--------------------LI            122
Pfu       R----EKVREHPAVVDIFEYDIP-FAKRY--------------------LI            122
Pabyssi   R----EKIREHPAVVDIFEYDIP-FAKRY--------------------LI            122
          *     .:    .  *  :   *         *:                **
```

FIG. 51A

```
Bst       SKQLASICRDAPVELSLDDIVYEGQDREKVIALFKELGFQSFLEKMAAPAAEGEKPLEEM    299
NOZ77     DKGLVPT------------AWVELQG-----RVEGSEFWV----EEVRRAEGPLPRL      155
9oN       DKGLIPA------------EGD---------------------------------EEL    135
Pfu       DKGLIPM------------EGE---------------------------------EEL    135
Pabyssi   DKGLTPM------------EGN---------------------------------EEL    135
          .* *                                                  ..

Bst       EFAIVDVITEEMLADKAALVVEVMEENYHDAPIVGIALVNEHGR-FFMRPETALADSQFL    358
NOZ77     KVMSFDIETYNPK----------GAPRGDQDPIIMVSMATSGGLRKVLSWKAPTAGLEFV   205
9oN       TMLAFDIETLYHE----------GEEFG-TGPILMISYADGSE-ARVITWKK--IDLPYV   181
Pfu       KILAFDIETLYHE----------GEEFG-KGPIIMISYADENE-AKVITWKN--IDLPYV   181
Pabyssi   TFLAVDIETLYHE----------GEEFG-KGPIIMISYADEEG-AKVITWKS--IDLPYV   181
          .   ***  .             **.       ..      .    . .    ..

Bst       AWLADETKKKSMF-------DAKRAVVALKWKGIELRGVAFDLLLAAYLLNPAQDA------    407
NOZ77     ETLEDEAAVLRRFEELVRQEDPDILVGY---NTDNFDF---PYLNQRLKALGIELALG      257
9oN       DVVSTEKEMIKRFLRVVREKDPDVLITY---NGDNFDF---AYLKKRCEELGIKFTLG      233
Pfu       EVVSSEREMIKRFLRIIREKDPDIIVTY---NGDSFDF---PYLAKRAEKLGIKLTIG      233
Pabyssi   EVVSSEREMIKRLVKVIREKDPDVIITY---NGDNFDF---PYLLKRAEKLGIKLPLG      233
          ..    .                       ** .         **           .

Bst       --------GDIA----AVAKMK-------QYEAVRSDEAVYGKGVKRSLPD             439
NOZ77     RDGSPHKTSTRMGMSETRMAGRPHMDLYPIVRRSLRLPSYVLEDVVAEVLGEEKEKVPG-    316
9oN       RDGSEPKIQRMGDRFAVEVKGRIHFDLYPIVRRTINLPTYLEAVYEAVFGKPKEKVYA-    292
Pfu       RDGSEPKMQRIGDMTAVEVKGRIHFDLYHVITRTINLPTYTLEAVYEAIFGKPKEKVYA-    292
Pabyssi   RDNSEPKMQRMGDSLAVEIKGRIHFDLFPVIRRTINLPTYTLEAVYEAIFGKSKEKVYA-    292
                                 *                  ..  ..
```

FIG. 51B

```
Bst       EQTLAEHLVRKAAAIWALEQPFMDDLRNNEQDLLTKLEQPLAAILAEMEFTGVNVDTKR    499
NOZ77     ------------ERMGEIWDKGGEELDRFFRYS------LED----------AE-       342
9oN       ----------------EEIAQAWES-GEGLERVARYS------MED----------AK-   317
Pfu       ----------------DEIAKAWES-GENLERVAKYS------MED----------AK-   317
Pabyssi   ---------------HEIAEAWET-GKGLERVAKYS------MED----------AK-    317
                          *                      :*:    .  . :

Bst       LEQMGSELAEQLRAIEQRIYELAGQEFNINSPKQLGVIL--------FEKLQLPVL----   547
NOZ77     -----VTLRIGEKYLPLYIELSRLVGQSIHDVARMTAGQLVEWYLMREAFARGEVIPERPGG 399
9oN       -----VTYELGREFFPMEAQLSRLIGQSLWDVSRSSTGNLVEWFLLRKAYKRNELAPNKPDE 374
Pfu       ----ATYELGKEFLPMEIQLSRLVGQPLWDVSRSSTGNLVEWFLLRKAYERNEVAPNKPSE  374
Pabyssi   ----VTFELGKEFFPMEAQLARLVGQPVWDVSRSSTGNLVEWFLLRKAYERNELAPNKPDE  374
                   *  . :: **  ::    *         .::  .

Bst       ------KKTKTGYSTSADVLEKLAPHHEIVENILHYRQLGKLQSTYIEGLLKVVRPDTGKVH 603
NOZ77     REFARRAGDTYEGG------YVREPRKGLLEKV--FDFRSLYPSVIV--THNIDPSTIRPG  450
9oN       RELARR-RGGYAGG------YVKEPERGLWDNIVYLDFRSLYPSIII---THNVSPDTLNRE 426
Pfu       EEYQRRLRESYTGG------FVKEPEKGLWENIVYLDFRALYPSIII---THNVSPDTLNLE 427
Pabyssi   REYERRLRESYEGG------YVKEPEKGLWEGIVSLDFRSLYPSIII---THNVSPDTLNRE 427
                    *             . *                 . .* *     **

Bst       TM--FNQALTQTGRLSSAEPNLQNIPI-----RLEEGRK-----IRQAFVPSEPDWLIFAAD 653
NOZ77     PG--ENQPPGIDYHFTTEKEGF---IPALLKRLIVARRAELKEEMKKARDPGERK---MLD  502
9oN       GCKEYDVAPEVGHKFCKDFPGF--IPSLLGDLLEERQKIKRKMKATVDPLEKK----LLD   480
Pfu       GCKNYDIAPQVGHKFCKDIPGF--IPSLLGHLLEERQKIKTKMKETQDPIEKI----LLD   481
Pabyssi   NCKEYDVAPQVGHRFCKDFPGF--IPSLLGNLLEERQKIKKRMKESKDPVEKK----LLD   481
                             *    **  .*:      :                    *

FIG. 51C
```

```
Bst       YSQIELRVLAHIADDDNLIEAFQRDLDIHTKTAMDIFHVSEEVTANMRRQAKAVNFGIV    713
NOZ77     VQQQALKILANSFYG---YMGYPRARWYRKECAESVTAFARDYIKKVMEVAEKEFGLEVV  559
9oN       YRQRAIKILANSFYG---YYGYAKARWYCKECAESVTAWGREYIEMVIRELEEKFGFKVL   537
Pfu       YRQKAIKLLANSFYG---YYGYAKARWYCKECAESVTAWGRKYIELVWKELEEKFGFKVL   538
Pabyssi   YRQRAIKILANSYYG---YYGYAKARWYCKECAESVTAWGRQYIDLVRRELE-SRGFKVL   537
             *    ::: **:                *        .    : *              ..

Bst       YGISDYGLAQN----LNITRKEAAEFIERYFASFPGVKQYMENIVQEAKQKGYVTTLLHR   769
NOZ77     YGDTDSLFILVPGGKK----ERAFAFLEEVNRRLPGTIELEYE----GFYRRGIF----VTK  609
9oN       YADTDGLHATIPGADAETVKKKAKEFLKYINPKLPGLLELEYE----GFYVRGFF----VTK  591
Pfu       YIDTDGLYATIPGGESEEIKKKALEFVKYINSKLPGLLELEYE----GFYKRGFF----VTK  592
Pabyssi   YIDTDGLYATIPGAKHEEIKEKALKFVEYINSKLPGLLELEYE----GFYARGFF----VTK  591
          *  :   .       . :    * :       *::**  ..

Bst       RRYLPDITSRNFNVRSFAERTAMNTPIQGSAADIIKKAMIDLAARLKEEQLQARLLLQVH   829
NOZ77     KRYALIDEKD----------RIIVKGLEFVRRDWAPIARDT----QEKVLK---        646
9oN       KKYAVIDEEG----------KITTRGLEIVRRDWSEIAKET----QARVLE---        628
Pfu       KRYAVIDEEG----------KVITRGLEIVRRDWSEIAKET----QARVLE---        629
Pabyssi   KKYALIDEEG----------KIVTRGLEIVRRDWSEIAKET----QAKVLE---        628
          ::              ::  :   .                         *  :  *

Bst       DELILEAPKEEIERLCELVPEVMEQAVTLRVPLKV-----------DYHYGPTWYDAK    876
NOZ77     -ALLKDA---SPEEAVRIVRKAMDDIRARRVSLEDLTIYTQLTKK------------    687
9oN       -AILKHG---DVEEAVRIVKEVTEKLSKYEVPPEKLVIHEQITRDLRDYKATGPHVAVAK  684
Pfu       -TILKHG---DVEEAVRIVKEVIQKLANYEIPPEKLAIYEQITRPLHEYKAIGPHVAVAK  685
Pabyssi   -AILKHG----NVDEAVKIVKEVTEKLSKYEIPPEKLVIYEQITRPLSEYKAIGPHVAVAK 684
           .   .        :.*:.: .: :.       :           ::  ..
```

FIG. 51D

```
Bst       ------------------------------------------------------------     876
NOZ77     ------------------------------------------------------------     687
9oN       RLAARGVKIRPGTVISYIVLKGSGRIGDRAIPADEFDPTKHRYDAEYYIENQVLPAVERI     744
Pfu       KLAAKGVKIKPGMVIGYIVLRGDGPISNRALLAEEYDPKKHKYDAEYYIENQVLPAVLRI     745
Pabyssi   RLAAKGVKVKPGMVIGYIVLRGDGPISKRAIAIEEFDPKKHKYDAEYYIENQVLPAVERI     744

Bst       ------------------------------------         876
NOZ77     ------------------------------------         687
9oN       LKAFGYRKEDLRYQKTKQVGLGAWLKVGKK          775
Pfu       LEGFGYRKEDLRYQKTRQVGLTSWLNIKKS-         775
Pabyssi   LRAFGYRKEDLKYQKTKQVGLGAWLKF----         771
```

FIG. 51E

ENGINEERED POLYMERASES WITH REDUCED SEQUENCE-SPECIFIC ERRORS

SEQUENCE LISTING

The instant application contains a Sequence Listing which has been submitted electronically in XML format and is hereby incorporated by reference in its entirety. Said XML copy, created on Jan. 27, 2023, is named 38119-52265_002USA1_SEQLISTING.xml and is 5,066 kilobytes in size.

CROSS REFERENCE TO RELATED APPLICATIONS

This application claims the benefit of and priority to U.S. Provisional Application Nos.: 63/311,939, filed on Feb. 18, 2022, 63/343,036, filed on May 17, 2022, and 63/479,490, filed on Jan. 11, 2023, each of which are incorporated herein by reference in their entireties for all purposes.

Throughout this application various publications, patents, and/or patent applications are referenced. The disclosures of the publications, patents and/or patent applications are hereby incorporated by reference in their entireties into this application in order to more fully describe the state of the art to which this disclosure pertains.

TECHNICAL FIELD

The present disclosure provides mutant polymerases that are engineered for improved thermal stability, exhibit improved binding of nucleotide reagents and/or improved binding and incorporation of nucleotide reagent, and/or improved uracil-tolerance and/or reduced sequence-specific sequencing errors. Exemplary nucleotide reagents include detectably labeled nucleotides, nucleotides comprising a 3' chain terminating moiety, phosphate chain-labeled nucleotides, and multivalent molecules. The mutant polymerases exhibit increased incorporation rate, compared to wild type polymerases.

BACKGROUND

Next-generation sequencing (NGS) techniques have become a powerful tool for acquiring sequencing data used in molecular biology techniques, taxonomy, agriscience, medical diagnostics, and the development of new therapies. The present disclosure provides engineered polymerase that are useful for conducting any nucleic acid sequencing method that employs labeled or non-labeled chain terminating nucleotides, where the chain terminating nucleotides include a 3'-O-azido group (or 3'-O-methylazido group) or any other type of bulky blocking group at the sugar 3' position. For example, the engineered polymerases can be used to conduct sequencing-by-avidity methods (SBA) using labeled multivalent molecules and non-labeled chain terminating nucleotides. Additionally, the engineered polymerases can be used for conducting sequencing-by-synthesis (SBS) methods which employ labeled chain-terminating nucleotides, and for conducting sequencing-by-binding methods (SBB) which employ non-labeled chain-terminating nucleotides.

The addition of a single nucleotide to a strand of DNA alone does not produce enough signal to easily detect. Currently available SBS technologies overcome this problem by increasing the signal to noise of the nucleotide addition coupled to a detection method with sufficient sensitivity to make an accurate base call. The most commercially successful platforms employ monoclonal template DNA amplification in a spatially constrained matrix to generate discrete DNA islands that contain multiple copies of a sequence to interrogate. The result of this amplification is a "colony" of DNA copies such that addition of a single DNA base on all of the copies concentrates the detection modality in a manner sufficient to overcome the signal to noise problem. The sequencing of multiple spatially constrained identical copies of DNA further increases the reliance on a controlled stepping mechanism to ensure that one, and only one, nucleotide bases can be added to ensure that all of the copies within a DNA colony remain at the same position (N, N+1, N+2, N+3, etc. . . . ) relative to each other.

The molecular engine needed to perform SBS is a DNA polymerase. In vivo, this class of enzymes is responsible for DNA replication and maintaining genome integrity. Under native conditions DNA dependent DNA polymerases (dDdP's) catalyze the addition of deoxynucleotide triphosphates (dNTP) to DNA in a 5' to 3' direction creating phosphodiester bonds between the 3' hydroxyl of the primer DNA terminus and the 5' alpha phosphate of the incoming nucleotide. This chemistry occurs with high fidelity for the correct Watson-Crick base pair due to hydrogen bonding between the correct incoming dNTP and the templating base. This "correct" base pairing induces a conformational change in the enzyme that aligns catalytic amino acids to efficiently perform phosphodiester bond formation. The newly added dNTP also possesses a 3'OH which is used in the next round of catalysis to further extend the DNA strand.

To ensure that only a single dNTP is added to the growing strands of DNA per SBS cycle a reversibly terminated dNTP is employed. These bases contain modifications to the 3' hydroxyl of the dNTP that block subsequent rounds of incorporation. The most commercially successful reversible terminator is the 3' methylazido, however others including 3'-aminoallyl, and 3' oxyamine has also been used. Each of these reversibly terminated dNTPs function in the same manner; once incorporated the bulky 3' block inhibits addition of the next nucleotide because no 3' hydroxyl is present. When exposed to a catalyst, the 3' block reacts to re-generate a 3' hydroxyl capable of forming a new phosphodiester bond during the next cycle. While effective, these bulky 3' modifications present a challenge for the polymerase.

The evolutionary need for high fidelity genome replication and stability has resulted in polymerases that only incorporate a non-Watson-Crick base pair in every $10^4$-$10^7$ incorporation events. Polymerases often also need to discriminate between vast excesses of nucleotides in the cellular environment. Discrimination between nucleotides is typically done through a steric gate where the presence of a 2'hydroxyl sterically clashes with an amino acid side chain at the nucleotide binding site to select against nucleotide binding and catalysis. Additionally, damage or modification to the 3' hydroxyl of the nucleotide is also sensed by the enzyme because bases containing non-viable 3' hydroxyls can act as chain terminators that inhibit DNA synthesis. Discrimination of these unwanted bases occurs through a kinetic pathway where incorrect nucleotide substrates bind with a weaker overall affinity and phosphodiester bond formation occurs at rates $10^2$-$10^4$ orders of magnitude more slowly. This occurs due to the lack of an induced fit that would properly align catalytic amino acids for bond formation. As a result, naturally evolved polymerases incorporate reversible chain-terminator nucleotides poorly.

BRIEF DESCRIPTION OF THE DRAWINGS

The patent or application file contains at least one drawing executed in color. Copies of this patent or patent application publication with color drawing(s) will be provided by the U.S. Patent and Trademark Office upon request and payment of the necessary fee.

The novel advantages and features of the compositions and methods disclosed herein are set forth with particularity in the appended claims. A better understanding of the features and advantages of the compositions and methods of the present disclosure will be obtained by reference to the following detailed description that sets forth illustrative embodiments and the accompanying drawings of which:

FIG. 7 shows the chemical structure of an exemplary spacer (TOP), and the chemical structures of various exemplary linkers, including an 11-atom Linker, 16-atom Linker, 23-atom Linker and an N3 Linker (BOTTOM).

FIG. 8 shows the chemical structures of various exemplary linkers, including Linkers 1-9.

FIG. 9A shows the chemical structures of various exemplary linkers joined/attached to nucleotide units.

FIG. 9B shows the chemical structures of various exemplary linkers joined/attached to nucleotide units.

FIG. 9C shows the chemical structures of various exemplary linkers joined/attached to nucleotide units.

FIG. 9D shows the chemical structures of various exemplary linkers joined/attached to nucleotide units.

FIG. 11 is the amino acid sequence of a wild DNA polymerase having a backbone sequence from RLF 89458.1 (SEQ ID NO:1).

FIG. 12 is the amino acid sequence of a wild DNA polymerase having a backbone sequence from RLF 78286.1 (SEQ ID NO:2).

FIG. 13 is the amino acid sequence of a wild DNA polymerase having a backbone sequence from NOZ 58130.1 (SEQ ID NO:1316).

FIG. 14 is the amino acid sequence of a wild type DNA polymerase having a backbone sequence from RMF 90817.1 (SEQ ID NO:2215).

FIG. 15 is the amino acid sequence of a wild type DNA polymerase having a backbone sequence from MBC 7218772.1 (SEQ ID NO:2367).

FIG. 16 is the amino acid sequence of a wild type DNA polymerase having a backbone sequence from WP 175059460.1 (SEQ ID NO:2393).

FIG. 17 is the amino acid sequence of a wild type DNA polymerase having a backbone sequence from KUO 42443.1 (SEQ ID NO:2408).

FIG. 18 is the amino acid sequence of a wild DNA polymerase having a backbone sequence from NOZ 77387.1 (SEQ ID NO:2436).

FIG. 19 is the amino acid sequence of a wild type DNA polymerase having a backbone sequence from Geobacillus stearothermophilus (Bst polymerase) (SEQ ID NO:2502).

FIG. 20 is the amino acid sequence of a 9° N polymerase (SEQ ID NO:2503).

FIG. 21 is the amino acid sequence of a 9° N polymerase UniProt Q56366 (SEQ ID NO:2504).

FIG. 22 is the amino acid sequence of THERMINATOR polymerase (SEQ ID NO:2505).

FIG. 23 is the amino acid sequence of a VENT polymerase UniProt P30317 (SEQ ID NO:2506).

FIG. 24 is the amino acid sequence of a DEEP VENT polymerase UniProt Q51334 (SEQ ID NO:2507).

FIG. 25 is the amino acid sequence of a Pfu polymerase UniProt P61875 (SEQ ID NO:2508).

FIG. 26 is the amino acid sequence of a *Pyrococcus abyssi* polymerase UniProt POCL77 (SEQ ID NO:2509).

FIG. 27 is the amino acid sequence of an RB69 polymerase (SEQ ID NO:2510).

FIG. 28 is the amino acid sequence of a Phi29 polymerase (SEQ ID NO:2455).

FIGS. 29A-29Q are Table 1 which lists the relative incorporation activity of mutant variants (SEQ ID NOS:3-293) carrying various mutation substitution sites. Table 1 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:1 of wild type DNA polymerase having a backbone sequence of RLF 89458.1.

FIGS. 30A-30Z are Table 2 which lists the fluorescent signal intensity of mutant variants (SEQ ID NOS:294-725) carrying various mutation substitution sites. The mutation substitution sites are relative to the numbering in SEQ ID NO:1 of wild type DNA polymerase having a backbone sequence of RLF 89458.1.

FIGS. 31A-31GG are Table 3 which lists mutant DNA polymerases having a backbone sequence of RLF 89458.1 and carrying various mutation substitution sites (SEQ ID NOS:726-1315). The mutation substitution sites are relative to the numbering in SEQ ID NO:1 of wild type DNA polymerase having a backbone sequence of RLF 89458.1.

FIGS. 32A-32G are Table 4 which lists the relative incorporation activity of mutant variants (SEQ ID NOS: 1317-1447) carrying various mutation substitution sites. Table 4 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:1316 of wild type DNA polymerase having a backbone sequence of NOZ 58130.1.

FIG. 33 is Table 5 which lists the fluorescent signal intensity of mutant variants (SEQ ID NOS:1448-1450) carrying various mutation substitution sites. The mutation substitution sites are relative to the numbering in SEQ ID NO:1316 of wild type DNA polymerase having a backbone sequence of NOZ 58130.1.

FIGS. 34A-34NN are Table 6 which lists mutant DNA polymerases having a backbone sequence of NOZ 58130.1 and carrying various mutation substitution sites (SEQ ID NOS:1451-2214). The mutation substitution sites are relative to the numbering in SEQ ID NO:1316 of wild type DNA polymerase having a backbone sequence of NOZ 58130.1.

FIG. 35 is Table 7 which lists the relative incorporation activity of mutant variants (SEQ ID NOS:2216-2236) carrying various mutation substitution sites. Table 7 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:2215 of wild type DNA polymerase having a backbone sequence of RMF 90817.1.

FIGS. 36A-36F are Table 8 which lists mutant DNA polymerases having a backbone sequence of RMF 90817.1 and carrying various mutation substitution sites (SEQ ID NOS:2237-2366). The mutation substitution sites are relative to the numbering in SEQ ID NO:2215 of wild type DNA polymerase having a backbone sequence of RMF 90817.1.

FIG. 37 is Table 9 which lists the relative incorporation activity of mutant variants (SEQ ID NOS:2368-2387) carrying various mutation substitution sites. Table 9 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:2367 of wild type DNA polymerase having a backbone sequence of MBC 7218772.1.

FIG. 38 is Table 10 which lists mutant DNA polymerases having a backbone sequence of MBC 7218772.1 and carrying various mutation substitution sites (SEQ ID NOS: 2388-2392). The mutation substitution sites are relative to the numbering in SEQ ID NO:2367 of wild type DNA polymerase having a backbone sequence of MBC 7218772.1.

FIGS. 39A-39B are Table 11 which lists mutant DNA polymerases having a backbone sequence of WP 175059460.1 and carrying various mutation substitution sites (SEQ ID NOS:2394-2407 and 2511-2523). The mutation substitution sites are relative to the numbering in SEQ ID NO:2393 of wild type DNA polymerase having a backbone sequence of WP 175059460.1.

FIG. 40 is Table 12 which lists the relative incorporation activity of mutant variants carrying various mutation substitution sites (SEQ ID NOS:2409-2424). Table 12 lists the incorporation activity of 3'methylazido nucleotides at the N+1 position of an extending polynucleotide chain at 42° C. The mutant variants are present in cleared lysates from expression strains. The mutation substitution sites are relative to the numbering in SEQ ID NO:2408 of wild type DNA polymerase having a backbone sequence of KUO 42443.1.

FIG. 41 is Table 13 which lists mutant DNA polymerases having a backbone sequence of KUO 42443.1 and carrying various mutation substitution sites (SEQ ID NOS:2425-2435). The mutation substitution sites are relative to the numbering in SEQ ID NO:2408 of wild type DNA polymerase having a backbone sequence of KUO 42443.1.

FIG. 42 is Table 14 which lists mutant DNA polymerases having a backbone sequence of NOZ 77387.1 and carrying various mutation substitution sites (SEQ ID NOS:2437-2454). The mutation substitution sites are relative to the numbering in SEQ ID NO:2436 of wild type DNA polymerase having a backbone sequence of NOZ 77387.1.

FIGS. 43A-43B are Table 15 which lists mutant DNA polymerases having a backbone sequence of Phi29 and carrying various mutation substitution sites (SEQ ID NOS: 2456-2501). The mutation substitution sites are relative to the numbering in SEQ ID NO:2455 of wild type DNA polymerase having a backbone sequence of Phi29.

FIGS. 44A-44E shows amino acid sequence alignments of DNA polymerases from: RLF 89458.1 (SEQ ID NO:1); NOZ 58130 (SEQ ID NO:1316); RMF 90817 (SEQ ID NO:2215); MBC 7218772 (SEQ ID NO:2367); WP 175059460 (SEQ ID NO:2393); KUO 42443 (SEQ ID NO:2408); and NOZ 77387 (SEQ ID NO:2436).

FIGS. 45A-45E shows amino acid sequence alignments of DNA polymerases from: RLF 89458.1 (SEQ ID NO:1); Geobacillus stearothermophilus (Bst polymerase) (SEQ ID NO:2502); 9° N (SEQ ID NO:2503); Pfu polymerase (SEQ ID NO:2508); and *Pyrococcus abyssi* polymerase (SEQ ID NO:2509).

FIGS. 46A-46E shows amino acid sequence alignments of DNA polymerases from: NOZ 58130 (SEQ ID NO:1316); Geobacillus stearothermophilus (Bst polymerase) (SEQ ID NO:2502); 9° N (SEQ ID NO:2503); Pfu polymerase (SEQ ID NO:2508); and *Pyrococcus abyssi* polymerase (SEQ ID NO:2509).

FIGS. 47A-47E shows amino acid sequence alignments of DNA polymerases from: RMF 90817 (SEQ ID NO:2215); Geobacillus stearothermophilus (Bst polymerase) (SEQ ID NO:2502); 9° N (SEQ ID NO:2503); Pfu polymerase (SEQ ID NO:2508); and *Pyrococcus abyssi* polymerase (SEQ ID NO:2509).

FIGS. 48A-48E shows amino acid sequence alignments of DNA polymerases from: MBC 7218772 (SEQ ID NO:2367); Geobacillus stearothermophilus (Bst polymerase) (SEQ ID NO:2502); 9° N (SEQ ID NO:2503); Pfu polymerase (SEQ ID NO:2508); and *Pyrococcus abyssi* polymerase (SEQ ID NO:2509).

FIGS. 49A-49E shows amino acid sequence alignments of DNA polymerases from: WP 175059460 (SEQ ID NO:2393); Geobacillus stearothermophilus (Bst polymerase) (SEQ ID NO:2502); 9° N (SEQ ID NO:2503); Pfu polymerase (SEQ ID NO:2508); and *Pyrococcus abyssi* polymerase (SEQ ID NO:2509).

FIGS. 50A-50E shows amino acid sequence alignments of DNA polymerases from: KUO 42443 (SEQ ID NO:2408); Geobacillus stearothermophilus (Bst polymerase) (SEQ ID NO:2502); 9° N (SEQ ID NO:2503); Pfu polymerase (SEQ ID NO:2508); and *Pyrococcus abyssi* polymerase (SEQ ID NO:2509).

FIGS. 51A-51E shows amino acid sequence alignments of DNA polymerases from: NOZ 77387 (SEQ ID NO:2436); Geobacillus stearothermophilus (Bst polymerase) (SEQ ID NO:2502); 9° N (SEQ ID NO:2503); Pfu polymerase (SEQ ID NO:2508); and *Pyrococcus abyssi* polymerase (SEQ ID NO:2509).

FIG. 63 also shows a plurality of multivalent molecules that are not part of the first binding complex.

DETAILED DESCRIPTION

Definitions

Figure 1:
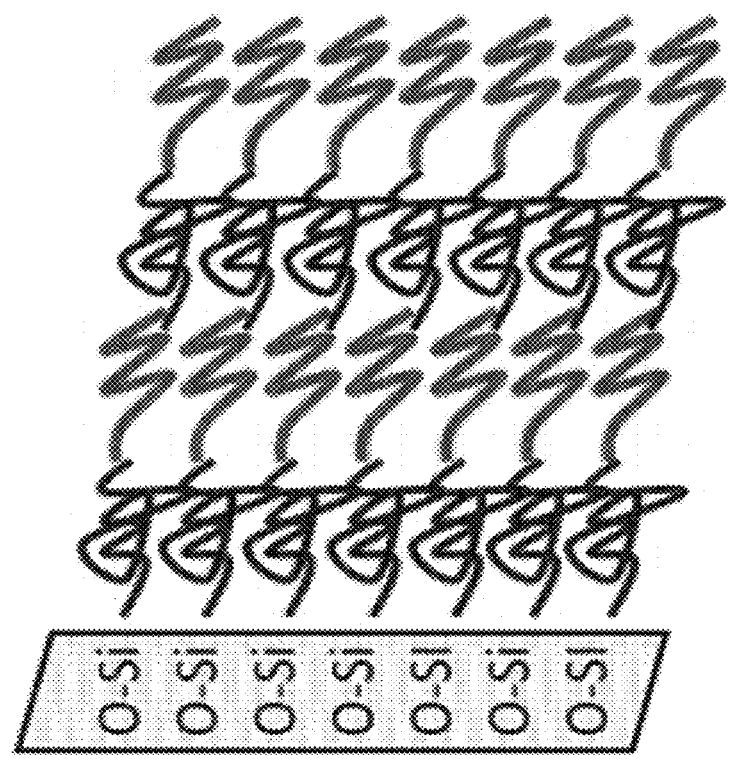
FIG. 1 is a schematic of an exemplary low binding support comprising a glass substrate and alternating layers of hydrophilic coatings which are covalently or non-covalently adhered to the glass, and which further comprises chemically-reactive functional groups that serve as attachment sites for oligonucleotide primers (e.g., capture oligonucleotides). in an alternative embodiment, the support can be made of any material such as glass, plastic or a polymer material.

The headings provided herein are not limitations of the various aspects of the disclosure, which aspects can be understood by reference to the specification as a whole.

Unless defined otherwise, technical and scientific terms used herein have meanings that are commonly understood by those of ordinary skill in the art unless defined otherwise. Generally, terminologies pertaining to techniques of molecular biology, nucleic acid chemistry, protein chemistry, genetics, microbiology, transgenic cell production, and hybridization described herein are those well-known and commonly used in the art. Techniques and procedures described herein are generally performed according to conventional methods well known in the art and as described in various general and more specific references that are cited and discussed throughout the instant specification. For example, see Sambrook et al., Molecular Cloning: A Laboratory Manual (Third ed., Cold Spring Harbor Laboratory Press, Cold Spring Harbor, N.Y. 2000). See also Ausubel et al., Current Protocols in Molecular Biology, Greene Publishing Associates (1992). The nomenclatures utilized in connection with, and the laboratory procedures and techniques described herein are those well-known and commonly used in the art.

Unless otherwise required by context herein, singular terms shall include pluralities and plural terms shall include the singular. Singular forms "a", "an" and "the", and singular use of any word, include plural referents unless expressly and unequivocally limited on one referent.

It is understood the use of the alternative term (e.g., "or") is taken to mean either one or both or any combination thereof of the alternatives.

The term "and/or" used herein is to be taken mean specific disclosure of each of the specified features or components with or without the other. For example, the term "and/or" as used in a phrase such as "A and/or B" herein is intended to include: "A and B"; "A or B"; "A" (A alone); and "B" (B alone). In a similar manner, the term "and/or" as used in a phrase such as "A, B, and/or C" is intended to encompass each of the following aspects: "A, B, and C"; "A, B, or C"; "A or C"; "A or B"; "B or C"; "A and B"; "B and C"; "A and C"; "A" (A alone); "B" (B alone); and "C" (C alone).

As used herein and in the appended claims, terms "comprising", "including", "having" and "containing", and their grammatical variants, as used herein are intended to be non-limiting so that one item or multiple items in a list do not exclude other items that can be substituted or added to the listed items. It is understood that wherever aspects are described herein with the language "comprising," otherwise analogous aspects described in terms of "consisting of" and/or "consisting essentially of" are also provided.

As used herein, the terms "about" and "approximately" refer to a value or composition that is within an acceptable error range for the particular value or composition as determined by one of ordinary skill in the art, which will depend in part on how the value or composition is measured or determined, i.e., the limitations of the measurement system. For example, "about" or "approximately" can mean within one or more than one standard deviation per the practice in the art. Alternatively, "about" or "approximately" can mean a range of up to 10% (i.e., ±10%) or more depending on the limitations of the measurement system. For example, about 5 mg can include any number between 4.5 mg and 5.5 mg. Furthermore, particularly with respect to biological systems or processes, the terms can mean up to an order of magnitude or up to 5-fold of a value. When particular values or compositions are provided in the instant disclosure, unless otherwise stated, the meaning of "about" or "approximately" should be assumed to be within an acceptable error range for that particular value or composition. Also, where ranges and/or subranges of values are provided, the ranges and/or subranges can include the endpoints of the ranges and/or subranges.

The terms "peptide", "polypeptide" and "protein" and other related terms used herein are used interchangeably and refer to a polymer of amino acids and are not limited to any particular length. Polypeptides may comprise natural and non-natural amino acids. Polypeptides include recombinant or chemically-synthesized forms. Polypeptides also include precursor molecules that have not yet been subjected to post-translation modification such as proteolytic cleavage, cleavage due to ribosomal skipping, hydroxylation, methylation, lipidation, acetylation, SUMOylation, ubiquitination, glycosylation, phosphorylation and/or disulfide bond formation. These terms encompass native and artificial proteins, protein fragments and polypeptide analogs (such as muteins, variants, chimeric proteins and fusion proteins) of a protein sequence as well as post-translationally, or otherwise covalently or non-covalently, modified proteins.

The term "polymerase" and its variants, as used herein, comprises any enzyme that can catalyze polymerization of nucleotides (including analogs thereof) into a nucleic acid strand. Typically but not necessarily such nucleotide polymerization can occur in a template-dependent fashion. Typically, a polymerase comprises one or more active sites at which nucleotide binding and/or catalysis of nucleotide polymerization can occur. In some embodiments, a polymerase can bind a nucleotide, nucleotide analog or multivalent molecule, and may or may not incorporate the nucleotide, nucleotide analog or a nucleotide unit of a multivalent molecule. In some embodiments, a polymerase includes other enzymatic activities, such as for example, 3' to 5' exonuclease activity or 5' to 3' exonuclease activity. In some embodiments, a polymerase has strand displacing activity. A polymerase can include without limitation naturally occurring polymerases and any subunits and truncations thereof, mutant polymerases, variant polymerases, recombinant, fusion or otherwise engineered polymerases, chemically modified polymerases, synthetic molecules or assemblies, and any analogs, derivatives or fragments thereof that retain the ability to catalyze nucleotide polymerization (e.g., catalytically active fragment). In some embodiments, a polymerase can be isolated from a cell, or generated using recombinant DNA technology or chemical synthesis methods. In some embodiments, a polymerase can be expressed in prokaryote, eukaryote, viral, or phage organisms. In some embodiments, a polymerase can be post-translationally modified proteins or fragments thereof. A polymerase can be derived from a prokaryote, eukaryote, virus or phage. A polymerase comprises DNA-directed DNA polymerase and RNA-directed DNA polymerase.

As used herein, the term "fidelity" refers to the accuracy of DNA polymerization by template-dependent DNA polymerase. The fidelity of a DNA polymerase is typically measured by the error rate (the frequency of incorporating an inaccurate nucleotide, i.e., a nucleotide that is not complementary to the template nucleotide). The accuracy or fidelity of DNA polymerization is maintained by both the polymerase activity and the 3'-5' exonuclease activity of a DNA polymerase.

As used herein, the term "binding complex" refers to a complex formed by binding together a nucleic acid duplex, a polymerase, and a free nucleotide or a nucleotide unit of a multivalent molecule, where the nucleic acid duplex comprises a nucleic acid template molecule hybridized to a nucleic acid primer. In the binding complex, the free nucleotide or nucleotide unit may or may not be bound to the 3' end of the nucleic acid primer at a position that is opposite a complementary nucleotide in the nucleic acid template molecule. A "ternary complex" is an example of a binding complex which is formed by binding together a nucleic acid duplex, a polymerase, and a free nucleotide or nucleotide unit of a multivalent molecule, where the free nucleotide or nucleotide unit is bound to the 3' end of the nucleic acid primer (as part of the nucleic acid duplex) at a position that is opposite a complementary nucleotide in the nucleic acid template molecule.

The term "persistence time" and related terms refers to the length of time that a binding complex remains stable without dissociation of any of the components, where the components of the binding complex include a nucleic acid template and nucleic acid primer, a polymerase, a nucleotide unit of a multivalent molecule or a free (e.g., unconjugated) nucleotide. The nucleotide unit or the free nucleotide can be complementary or non-complementary to a nucleotide residue in the template molecule. The nucleotide unit or the free nucleotide can bind to the 3' end of the nucleic acid primer at a position that is opposite a complementary nucleotide residue in the nucleic acid template molecule. The persistence time is indicative of the stability of the binding complex and strength of the binding interactions. Persistence time can be measured by observing the onset and/or duration of a binding complex, such as by observing a signal from a labeled component of the binding complex. For example, a labeled nucleotide or a labeled reagent comprising one or more nucleotides may be present in a binding complex, thus allowing the signal from the label to be detected during the persistence time of the binding complex. One exemplary label is a fluorescent label. The binding complex (e.g., ternary complex) remains stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water.

The terms "nucleic acid", "polynucleotide" and "oligonucleotide" and other related terms used herein are used interchangeably and refer to polymers of nucleotides and are not limited to any particular length. Nucleic acids include recombinant and chemically-synthesized forms. Nucleic acids include DNA molecules (e.g., cDNA or genomic DNA), RNA molecules (e.g., mRNA), analogs of the DNA or RNA generated using nucleotide analogs (e.g., peptide nucleic acids and non-naturally occurring nucleotide analogs), and chimeric forms containing DNA and RNA. Nucleic acids can be single-stranded or double-stranded. Nucleic acids comprise polymers of nucleotides, where the nucleotides include natural or non-natural bases and/or sugars. Nucleic acids comprise naturally-occurring internucleosidic linkages, for example phosphdiester linkages. Nucleic acids comprise non-natural internucleoside linkages, including phosphorothioate, phosphorothiolate, or peptide nucleic acid (PNA) linkages. In some embodiments, nucleic acids comprise a one type of polynucleotides or a mixture of two or more different types of polynucleotides.

The term "primer" and related terms used herein refers to an oligonucleotide, either natural or synthetic, that is capable of hybridizing with a DNA and/or RNA polynucleotide template to form a duplex molecule. Primers may have any length, but typically range from 4-50 nucleotides. A typical primer comprises a 5' end and 3' end. The 3' end of the primer can include a 3' OH moiety which serves as a nucleotide polymerization initiation site in a polymerase-mediated primer extension reaction. Alternatively, the 3' end of the primer can lack a 3' OH moiety, or can include a terminal 3' blocking group that inhibits nucleotide polymerization in a polymerase-mediated reaction. Any one nucleotide, or more than one nucleotide, along the length of the primer can be labeled with a detectable reporter moiety. A primer can be in solution (e.g., a soluble primer) or can be immobilized to a support (e.g., a capture primer).

The term "template nucleic acid", "template polynucleotide", "target nucleic acid" "target polynucleotide", "template strand" and other variations refer to a nucleic acid strand that serves as the basis nucleic acid molecule for generating a complementary nucleic acid strand. The sequence of the template nucleic acid can be partially or wholly complementary to the sequence of the complementary strand. The template nucleic acid can be obtained from a naturally-occurring source, recombinant form, or chemically synthesized to include any type of nucleic acid analog. The template nucleic acid can be linear, circular, or other forms. The template nucleic acids can be isolated in any form, including chromosomal, genomic, organellar (e.g., mitochondrial, chloroplast or ribosomal), recombinant molecules, cloned, amplified, cDNA, RNA such as precursor mRNA or mRNA, oligonucleotides, whole genomic DNA, obtained from fresh frozen paraffin embedded tissue, needle biopsies, cell free circulating DNA, or any type of nucleic acid library. The template nucleic acid molecules may be isolated from any source including from organisms such as prokaryotes, eukaryotes (e.g., humans, plants and animals), fungus, and viruses; cells; tissues; normal or diseased cells or tissues, body fluids including blood, urine, serum, lymph, tumor, saliva, anal and vaginal secretions, amniotic samples, perspiration, and semen; environmental samples; culture samples; or synthesized nucleic acid molecules prepared using recombinant molecular biology or chemical synthesis methods. The template nucleic acid can be subjected to nucleic acid analysis, including sequencing and composition analysis.

When used in reference to nucleic acid molecules, the terms "hybridize" or "hybridizing" or "hybridization" or other related terms refers to hydrogen bonding between two different nucleic acids to form a duplex nucleic acid. Hybridization also includes hydrogen bonding between two different regions of a single nucleic acid molecule to form a self-hybridizing molecule having a duplex region. Hybridization can comprise Watson-Crick or Hoogstein binding to form a duplex double-stranded nucleic acid, or a double-stranded region within a nucleic acid molecule. The double-stranded nucleic acid, or the two different regions of a single nucleic acid, may be wholly complementary, or partially complementary.

Complementary nucleic acid strands need not hybridize with each other across their entire length. The complementary base pairing can be the standard A-T or C-G base pairing, or can be other forms of base-pairing interactions. Duplex nucleic acids can include mismatched base-paired nucleotides.

The term "nucleotides" and related terms refers to a molecule comprising an aromatic base, a five carbon sugar (e.g., ribose or deoxyribose), and at least one phosphate group. Canonical or non-canonical nucleotides are consistent with use of the term. The phosphate in some embodiments comprises a monophosphate, diphosphate, or triphosphate, or corresponding phosphate analog. In some embodiments, the nucleotide comprises 1, 2, 3, 4, 5, 6, 7, 8, 9 or 10 phosphate groups. The term "nucleoside" refers to a molecule comprising an aromatic base and a sugar.

Nucleotides (and nucleosides) typically comprise a hetero cyclic base including substituted or unsubstituted nitrogen-containing parent heteroaromatic ring which are commonly found in nucleic acids, including naturally-occurring, substituted, modified, or engineered variants, or analogs of the same. The base of a nucleotide (or nucleoside) is capable of forming Watson-Crick and/or Hoogstein hydrogen bonds with an appropriate complementary base. Exemplary bases include, but are not limited to, purines and pyrimidines such as: 2-aminopurine, 2,6-diaminopurine, adenine (A), ethenoadenine, $N^6$-$\Delta^2$-isopentenyladenine (6iA), $N^6$-42-isopentenyl-2-methylthioadenine (2ms6iA), $N^6$-methyladenine, guanine (G), isoguanine, $N^2$-dimethylguanine (dmG), 7-methylguanine (7mG), 2-thiopyrimidine, 6-thioguanine (6sG), hypoxanthine and 06-methylguanine; 7-deaza-purines such as 7-deazaadenine (7-deaza-A) and 7-deazaguanine (7-deaza-G); pyrimidines such as cytosine (C), 5-propynylcytosine, isocytosine, thymine (T), 4-thiothymine (4sT), 5,6-dihydrothymine, 04-methylthymine, uracil (U), 4-thiouracil (4sU) and 5,6-dihydrouracil (dihydrouracil; D); indoles such as nitroindole and 4-methylindole; pyrroles such as nitropyrrole; nebularine; inosines; hydroxymethylcytosines; 5-methycytosines; base (Y); as well as methylated, glycosylated, and acylated base moieties; and the like. Additional exemplary bases can be found in Fasman, 1989, in "Practical Handbook of Biochemistry and Molecular Biology", pp. 385-394, CRC Press, Boca Raton, Fla.

Nucleotides (and nucleosides) typically comprise a sugar moiety, such as carbocyclic moiety (Ferraro and Gotor 2000 Chem. Rev. 100: 4319-48), acyclic moieties (Martinez, et al., 1999 Nucleic Acids Research 27: 1271-1274; Martinez, et al., 1997 Bioorganic & Medicinal Chemistry Letters vol. 7: 3013-3016), and other sugar moieties (Joeng, et al., 1993 J. Med. Chem. 36: 2627-2638; Kim, et al., 1993 J. Med. Chem. 36: 30-7; Eschenmosser 1999 Science 284:2118-2124; and U.S. Pat. No. 5,558,991). The sugar moiety comprises: ribosyl; 2'-deoxyribosyl; 3'-deoxyribosyl; 2',3'-dideoxyribosyl; 2',3'-didehydrodideoxyribosyl; 2'-alkoxyribosyl; 2'-azidoribosyl; 2'-aminoribosyl; 2'-fluororibosyl; 2'-mercaptoriboxyl; 2'-alkylthioribosyl; 3'-alkoxyribosyl; 3'-azidoribosyl; 3'-aminoribosyl; 3'-fluororibosyl; 3'-mercaptoriboxyl; 3'-alkylthioribosyl carbocyclic; acyclic or other modified sugars.

In some embodiments, nucleotides comprise a chain of one, two or three phosphorus atoms where the chain is typically attached to the 5' carbon of the sugar moiety via an ester or phosphoramide linkage. In some embodiments, the nucleotide is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphordithioate, and O-methylphosphoroamidite groups.

When used in reference to nucleic acids, the terms "extend", "extending", "extension" and other variants, refers to incorporation of one or more nucleotides into a nucleic acid molecule. Nucleotide incorporation comprises polymerization of one or more nucleotides into the terminal 3' OH end of a nucleic acid strand, resulting in extension of the nucleic acid strand. Nucleotide incorporation can be conducted with natural nucleotides and/or nucleotide analogs. Typically, but not necessarily, nucleotide incorporation occurs in a template-dependent fashion. Any suitable method of extending a nucleic acid molecule may be used, including primer extension catalyzed by a DNA polymerase or RNA polymerase.

The term "reporter moiety", "reporter moieties" or related terms refers to a compound that generates, or causes to generate, a detectable signal. A reporter moiety is sometimes called a "label". Any suitable reporter moiety may be used, including luminescent, photoluminescent, electroluminescent, bioluminescent, chemiluminescent, fluorescent, phosphorescent, chromophore, radioisotope, electrochemical, mass spectrometry, Raman, hapten, affinity tag, atom, or an enzyme. A reporter moiety generates a detectable signal resulting from a chemical or physical change (e.g., heat, light, electrical, pH, salt concentration, enzymatic activity, or proximity events). A proximity event includes two reporter moieties approaching each other, or associating with each other, or binding each other. It is well known to one skilled in the art to select reporter moieties so that each absorbs excitation radiation and/or emits fluorescence at a wavelength distinguishable from the other reporter moieties to permit monitoring the presence of different reporter moieties in the same reaction or in different reactions. Two or more different reporter moieties can be selected having spectrally distinct emission profiles, or having minimal overlapping spectral emission profiles. Reporter moieties can be linked (e.g., operably linked) to nucleotides, nucleosides, nucleic acids, enzymes (e.g., polymerases or reverse transcriptases), or support (e.g., surfaces).

A reporter moiety (or label) comprises a fluorescent label or a fluorophore. Exemplary fluorescent moieties which may serve as fluorescent labels or fluorophores include, but are not limited to fluorescein and fluorescein derivatives such as carboxyfluorescein, tetrachlorofluorescein, hexachlorofluorescein, carboxynapthofluorescein, fluorescein isothiocyanate, NHS-fluorescein, iodoacetamidofluorescein, fluorescein maleimide, SAMSA-fluorescein, fluorescein thiosemicarbazide, carbohydrazinomethylthioacetyl-amino fluorescein, rhodamine and rhodamine derivatives such as TRITC, TMR, lissamine rhodamine, Texas Red, rhodamine B, rhodamine 6G, rhodamine 10, NHS-rhodamine, TMR-iodoacetamide, lissamine rhodamine B sulfonyl chloride, lissamine rhodamine B sulfonyl hydrazine, Texas Red sulfonyl chloride, Texas Red hydrazide, coumarin and coumarin derivatives such as AMCA, AMCA-NHS, AMCA-sulfo-NHS, AMCA-HPDP, DCIA, AMCE-hydrazide, BODIPY and derivatives such as BODIPY FL C3-SE, BODIPY 530/550 C3, BODIPY 530/550 C3-SE, BODIPY 530/550 C3 hydrazide, BODIPY 493/503 C3 hydrazide, BODIPY FL C3 hydrazide, BODIPY FL IA, BODIPY 530/551 IA, Br-BODIPY 493/503, Cascade Blue and derivatives such as Cascade Blue acetyl azide, Cascade Blue cadaverine, Cascade Blue ethylenediamine, Cascade Blue hydrazide, Lucifer Yellow and derivatives such as Lucifer Yellow iodoacetamide, Lucifer Yellow CH, cyanine and derivatives such as indolium based cyanine dyes, benzo-indolium based cyanine dyes, pyridium based cyanine dyes, thiozolium based cyanine dyes, quinolinium based cyanine dyes, imidazolium based cyanine dyes, Cy 3, Cy5, lanthanide chelates and derivatives such as BCPDA, TBP, TMT, BHHCT, BCOT, Europium chelates, Terbium chelates, Alexa Fluor dyes, DyLight dyes, Atto dyes, LightCycler Red dyes, CAL Flour dyes, JOE and derivatives thereof, Oregon Green dyes, WellRED dyes, IRD dyes, phycoerythrin and phycobilin dyes, Malachite green, stilbene, DEG dyes, NR dyes, near-infrared dyes and others known in the art such as those described in Haugland, Molecular Probes Handbook, (Eugene, Oreg.) 6th Edition; Lakowicz, Principles of Fluorescence Spectroscopy, 2nd Ed., Plenum Press New York (1999), or Hermanson, Bioconjugate Techniques, 2nd Edition, or derivatives thereof, or any combination thereof. Cyanine dyes may exist in either sulfonated or non-sulfonated forms, and consist of two indolenin, benzo-indolium, pyridium, thiozolium, and/or quinolinium groups separated by a polymethine bridge between two nitrogen atoms. Commercially available cyanine fluorophores include, for example, Cy3, (which may comprise 1-[6-(2,5-dioxopyrrolidin-1-yloxy)-6-oxohexyl]-2-(3-{1-[6-(2,5-dioxopyrrolidin-1-yloxy)-6-oxohexyl]-3,3-dimethyl-1,3-dihydro-2H-indol-2-ylidene}prop-1-en-1-yl)-3,3-dimethyl-3H-indolium or 1-[6-(2,5-dioxopyrrolidin-1-yloxy)-6-oxohexyl]-2-(3-{1-[6-(2,5-dioxopyrrolidin-1-yloxy)-6-oxohexyl]-3,3-dimethyl-5-sulfo-1,3-dihydro-2H-indol-2-ylidene}prop-1-en-1-yl)-3,3-dimethyl-3H-indolium-5-sulfonate), Cy5 (which may comprise 1-(6-((2,5-dioxopyrrolidin-1-yl)oxy)-6-oxohexyl)-2-((1E,3E)-5-((E)-1-(6-((2,5-dioxopyrrolidin-1-yl)oxy)-6-oxohexyl)-3,3-dimethyl-5-indolin-2-ylidene)penta-1,3-dien-1-yl)-3,3-dimethyl-3H-indol-1-ium or 1-(6-((2,5-dioxopyrrolidin-1-yl)oxy)-6-oxohexyl)-2-((1E,3E)-5-((E)-1-(6-((2,5-dioxopyrrolidin-1-yl)oxy)-6-oxohexyl)-3,3-dimethyl-5-sulfoindolin-2-ylidene)penta-1,3-dien-1-yl)-3,3-dimethyl-3H-indol-1-ium-5-sulfonate), and Cy7 (which may comprise 1-(5-carboxypentyl)-2-[(1E,3E,5E,7Z)-7-(1-ethyl-1,3-dihydro-2H-indol-2-ylidene)hepta-1,3,5-trien-1-yl]-3H-indolium or 1-(5-carboxypentyl)-2-[(1E,3E,5E,7Z)-7-(1-ethyl-5-sulfo-1,3-dihydro-2H-indol-2-ylidene)hepta-1,3,5-trien-1-yl]-3H-indolium-5-sulfonate), where "Cy" stands for 'cyanine', and the first digit identifies the number of carbon atoms between two indolenine groups. Cy2 which is an oxazole derivative rather than indolenin, and the benzo-derivatized Cy3.5, Cy5.5 and Cy7.5 are exceptions to this rule.

In some embodiments, the reporter moiety can be a FRET pair, such that multiple classifications can be performed under a single excitation and imaging step. As used herein, FRET may comprise excitation exchange (Forster) transfers, or electron-exchange (Dexter) transfers.

The terms "linked", "joined", "attached", and variants thereof comprise any type of fusion, bond, adherence or association between any combination of compounds or molecules that is of sufficient stability to withstand use in the particular procedure. The procedure can include but are not limited to: nucleotide transient-binding; nucleotide incorporation; de-blocking; washing; removing; flowing; detecting; imaging and/or identifying. Such linkage can comprise, for example, covalent, ionic, hydrogen, dipole-dipole, hydrophilic, hydrophobic, or affinity bonding, bonds or associations involving van der Waals forces, mechanical bonding, and the like. In some embodiments, such linkage occurs intramolecularly, for example linking together the ends of a single-stranded or double-stranded linear nucleic acid molecule to form a circular molecule. In some embodiments, such linkage can occur between a combination of different molecules, or between a molecule and a non-molecule, including but not limited to: linkage between a nucleic acid molecule and a solid surface; linkage between a protein and a detectable reporter moiety; linkage between a nucleotide and detectable reporter moiety; and the like. Some examples of linkages can be found, for example, in Hermanson, G., "Bioconjugate Techniques", Second Edition (2008); Aslam, M., Dent, A., "Bioconjugation: Protein Coupling Techniques for the Biomedical Sciences", London: Macmillan (1998); Aslam, M., Dent, A., "Bioconjugation: Protein Coupling Techniques for the Biomedical Sciences", London: Macmillan (1998).

The term "operably linked" and "operably joined" or related terms as used herein refers to juxtaposition of components. The juxtapositioned components can be linked together covalently. For example, two nucleic acid components can be enzymatically ligated together where the linkage that joins together the two components comprises phosphodiester linkage. A first and second nucleic acid component can be linked together, where the first nucleic acid component can confer a function on a second nucleic acid component. For example, linkage between a primer binding sequence and a sequence of interest forms a nucleic acid library molecule having a portion that can bind to a primer. In another example, a transgene (e.g., a nucleic acid encoding a polypeptide or a nucleic acid sequence of interest) can be ligated to a vector where the linkage permits expression or functioning of the transgene sequence contained in the vector. In some embodiments, a transgene is operably linked to a host cell regulatory sequence (e.g., a promoter sequence) that affects expression of the transgene. In some embodiments, the vector comprises at least one host cell regulatory sequence, including a promoter sequence, enhancer, transcription and/or translation initiation sequence, transcription and/or translation termination sequence, polypeptide secretion signal sequences, and the like. In some embodiments, the host cell regulatory sequence controls expression of the level, timing and/or location of the transgene.

In some embodiments, the support is solid, semi-solid, or a combination of both. In some embodiments, the support is porous, semi-porous, non-porous, or any combination of porosity. In some embodiments, the support can be substantially planar, concave, convex, or any combination thereof. In some embodiments, the support can be cylindrical, for example comprising a capillary or interior surface of a capillary.

In some embodiments, the surface of the support can be substantially smooth. In some embodiments, the support can be regularly or irregularly textured, including bumps, etched, pores, three-dimensional scaffolds, or any combination thereof.

In some embodiments, the support comprises a bead having any shape, including spherical, hemi-spherical, cylindrical, barrel-shaped, toroidal, disc-shaped, rod-like, conical, triangular, cubical, polygonal, tubular or wire-like.

The support can be fabricated from any material, including but not limited to glass, fused-silica, silicon, a polymer (e.g., polystyrene (PS), macroporous polystyrene (MPPS), polymethylmethacrylate (PMMA), polycarbonate (PC), polypropylene (PP), polyethylene (PE), high density polyethylene (HDPE), cyclic olefin polymers (COP), cyclic olefin copolymers (COC), polyethylene terephthalate (PET)), or any combination thereof. Various compositions of both glass and plastic substrates are contemplated.

In some embodiments, the surface of the support is coated with one or more compounds to produce a passivated layer on the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that may be used for immobilizing a plurality of nucleic acid template molecules to the support.

In some embodiments, the degree of hydrophilicity (or "wettability" with aqueous solutions) of the surface coatings may be assessed, for example, through the measurement of water contact angles in which a small droplet of water is placed on the surface and its angle of contact with the surface is measured using, e.g., an optical tensiometer. In some embodiments, a static contact angle may be determined. In some embodiments, an advancing or receding contact angle may be determined. In some embodiments, the water contact angle for the hydrophilic, low-binding support surfaced disclosed herein may range from about 0 degrees to about 30 degrees. In some embodiments, the water contact angle for the hydrophilic, low-binding support surfaced disclosed herein may no more than 50 degrees, 40 degrees, 30 degrees, 25 degrees, 20 degrees, 18 degrees, 16 degrees, 14 degrees, 12 degrees, 10 degrees, 8 degrees, 6 degrees, 4 degrees, 2 degrees, or 1 degree. In many cases the contact angle is no more than 40 degrees. Those of skill in the art will realize that a given hydrophilic, low-binding support surface of the present disclosure may exhibit a water contact angle having a value of anywhere within this range.

The present disclosure provides a plurality (e.g., two or more) of nucleic acid templates immobilized to a support. In some embodiments, the immobilized plurality of nucleic acid templates have the same sequence or have different sequences. In some embodiments, individual nucleic acid template molecules in the plurality of nucleic acid templates are immobilized to a different site on the support. In some embodiments, two or more individual nucleic acid template molecules in the plurality of nucleic acid templates are immobilized to a site on the support. In some embodiments, the support comprises a plurality of sites arranged in an array. The term "array" refers to a support comprising a plurality of sites located at pre-determined locations on the support to form an array of sites. The sites can be discrete and separated by interstitial regions. In some embodiments, the pre-determined sites on the support can be arranged in one dimension in a row or a column, or arranged in two dimensions in rows and columns. In some embodiments, the plurality of pre-determined sites is arranged on the support in an organized fashion. In some embodiments, the plurality of pre-determined sites is arranged in any organized pattern, including rectilinear, hexagonal patterns, grid patterns, patterns having reflective symmetry, patterns having rotational symmetry, or the like. The pitch between different pairs of sites can be that same or can vary in some embodiments, the support can have nucleic acid template molecules immobilized at a plurality of sites at a surface density of about $10^2$-$10^{15}$ sites per $mm^2$, or more, to form a nucleic acid template array. In some embodiments, the support comprises at least $10^2$ sites, at least $10^3$ sites, at least $10^4$ sites, at least $10^5$ sites, at least $10^6$ sites, at least $10^7$ sites, at least $10^8$ sites, at least $10^9$ sites, at least $10^{10}$ sites, at least $10^{11}$ sites, at least $10^{12}$ sites, at least $10^{13}$ sites, at least $10^{14}$ sites, at least $10^{15}$ sites, or more, where the sites are located at pre-determined locations on the support. In some embodiments, a plurality of pre-determined sites on the support (e.g., $10^2$-$10^{15}$ sites or more) are immobilized with nucleic acid templates to form a nucleic acid template array. In some embodiments, the nucleic acid templates that are immobilized at a plurality of pre-determined sites by hybridization to immobilized surface capture primers, or the nucleic acid templates are covalently attached to the surface capture primers. In some embodiments, the nucleic acid templates that are immobilized at a plurality of pre-determined sites, for example immobilized at $10^2$-$10^{15}$ sites or more. In some embodiments, the nucleic acid templates that are immobilized at a plurality of sites on the support comprise linear or circular nucleic acid template molecules or a mixture of both linear and circular molecules. In some embodiments, the immobilized nucleic acid templates are clonally-amplified to generate immobilized nucleic acid polonies at the plurality of pre-determined sites. In some embodiments, individual immobilized nucleic acid template molecules comprise one copy of a target sequence of interest, or comprise concatemers having two or more tandem copies of a target sequence of interest.

In some embodiments, a support comprising a plurality of sites located at random locations on the support is referred to herein as a support having randomly located sites thereon. The location of the randomly located sites on the support are not pre-determined. The plurality of randomly-located sites is arranged on the support in a disordered and/or unpredictable fashion. In some embodiments, the support comprises at least $10^2$ sites, at least $10^3$ sites, at least $10^4$ sites, at least $10^5$ sites, at least $10^6$ sites, at least $10^7$ sites, at least $10^8$ sites, at least $10^9$ sites, at least $10^{10}$ sites, at least $10^{11}$ sites, at least $10^{12}$ sites, at least $10^{13}$ sites, at least $10^{14}$ sites, at least $10^{15}$ sites, or more, where the sites are randomly located on the support. In some embodiments, a plurality of randomly located sites on the support (e.g., $10^2$-$10^{15}$ sites or more) are immobilized with nucleic acid templates to form a support immobilized with nucleic acid templates. In some embodiments, the nucleic acid templates that are immobilized at a plurality of randomly located sites by hybridization to immobilized surface capture primers, or the nucleic acid templates are covalently attached to the surface capture primer. In some embodiments, the nucleic acid templates that are immobilized at a plurality of randomly located sites, for example immobilized at $10^2$-$10^{15}$ sites or more. In some embodiments, the nucleic acid templates that are immobilized at a plurality of sites on the support comprise linear or circular nucleic acid template molecules or a mixture of both linear and circular molecules. In some embodiments, the immobilized nucleic acid templates are clonally-amplified to generate immobilized nucleic acid polonies at the plurality of randomly located sites. In some embodiments, individual immobilized nucleic acid template molecules comprise one copy of a target sequence of interest, or comprise concatemers having two or more tandem copies of a target sequence of interest.

In some embodiments, with respect to nucleic acid template molecules immobilized to pre-determined or random sites on the support, the plurality of immobilized nucleic acid template molecules on the support are in fluid communication with each other to permit flowing a solution of reagents (e.g., enzymes including polymerases, multivalent molecules, nucleotides, divalent cations and/or buffers and the like) onto the support so that the plurality of immobilized nucleic acid template molecules on the support can be reacted with the reagents in a massively parallel manner. In some embodiments, the fluid communication of the plurality of immobilized nucleic acid template molecules can be used to conduct nucleotide binding assays and/or conduct nucleotide polymerization reactions (e.g., primer extension or sequencing) on the plurality of immobilized nucleic acid template molecules, and to conduct detection and imaging for massively parallel sequencing. In some embodiments, the term "immobilized" and related terms refer to nucleic acid molecules or enzymes (e.g., polymerases) that are attached to the support at pre-determined or random locations, where the nucleic acid molecules or enzymes are attached directly to a support through covalent bond or non-covalent interaction, or the nucleic acid molecules or enzymes are attached to a coating on the support.

As used herein, the term "clonally amplified" and it variants refers to a nucleic acid template molecule that has been subjected to one or more amplification reactions either in-solution or on-support. In the case of in-solution amplified template molecules, the resulting amplicons are distributed onto the support. Prior to amplification, the template molecule comprises a sequence of interest and at least one universal adaptor sequence. In some embodiments, clonal amplification comprises the use of a polymerase chain reaction (PCR), multiple displacement amplification (MDA), transcription-mediated amplification (TMA), nucleic acid sequence-based amplification (NASBA), strand displacement amplification (SDA), real-time SDA, bridge amplification, isothermal bridge amplification, rolling circle amplification (RCA), circle-to-circle amplification, helicase-dependent amplification, recombinase-dependent amplification, single-stranded binding (SSB) protein-dependent amplification, or any combination thereof.

As used herein, the term "sequencing" and its variants comprise obtaining sequence information from a nucleic acid strand, typically by determining the identity of at least some nucleotides (including their nucleobase components) within the nucleic acid template molecule. While in some embodiments, "sequencing" a given region of a nucleic acid molecule includes identifying each and every nucleotide within the region that is sequenced, in some embodiments "sequencing" comprises methods whereby the identity of only some of the nucleotides in the region is determined, while the identity of some nucleotides remains undetermined or incorrectly determined. Any suitable method of sequencing may be used. In an exemplary embodiment, sequencing methods can employ label-free or ion based sequencing methods. In some embodiments, sequencing methods can employ labeled or dye-containing nucleotide or fluorescent based nucleotide sequencing methods. In some embodiments, sequencing methods can employ labeled or un-labeled multivalent molecules. In some embodiments, sequencing can include polony-based sequencing or bridge sequencing methods. In some embodiments, sequencing includes massively parallel sequencing platforms that employ sequence-by-synthesis, sequence-by-hybridization or sequence-by-binding procedures. Examples of massively parallel sequence-by-synthesis procedures include polony sequencing, pyrosequencing (e.g., from 454 Life Sciences; U.S. Pat. Nos. 7,211,390, 7,244,559 and 7,264,929), chain-terminator sequencing (e.g., from Illumina; U.S. Pat. No. 7,566,537; Bentley 2006 Current Opinion Genetics and Development 16:545-552; and Bentley, et al., 2008 Nature 456:53-59, ion-sensitive sequencing (e.g., from Ion Torrent), probe-anchor ligation sequencing (e.g., Complete Genomics), DNA nanoball sequencing, nanopore DNA sequencing. Examples of single molecule sequencing include Heliscope single molecule sequencing, and single molecule real time (SMRT) sequencing. An example of sequence-by-hybridization includes SOLiD sequencing (e.g., from Life Technologies; WO 2006/084132). An example of sequence-by-binding includes Omniome sequencing (e.g., U.S. Pat. No. 10,246,744).

Engineered Polymerases that Exhibit Reduced Sequence-Specific Errors

The present disclosure provides compositions comprising mutant polymerases having amino acid substitutions and/or truncated amino acid sequences, nucleic acids encoding the mutant polymerases, and systems and kits comprising mutant polymerases. Further provided herein are methods using the mutant polymerases, including methods for binding a nucleic acid duplex, binding and/or incorporating nucleotide reagents, binding a complementary nucleotide or binding a multivalent molecule having a complementary nucleotide unit, incorporating a complementary nucleotide, extending a primer, and nucleic acid sequencing, where the methods employ any of the mutant polymerases described herein. The mutant polymerases are engineered to exhibit desirable characteristics including exonuclease-minus activity and increased thermal stability compared to a corresponding wild type polymerase, improved uracil-tolerance and/or reduced sequence-specific errors. Additionally, the mutant polymerase can be engineered to express a higher fraction of soluble expressed enzyme.

The present disclosure provides mutant polymerases that can be used to conduct a two-stage nucleic acid sequencing method. In some embodiments, the first stage generally comprises binding detectably-labeled multivalent molecules to complexed polymerases to form multivalent-complexed polymerases under a condition suitable to inhibit incorporation of a nucleotide unit, and detecting the multivalent-complexed polymerases. The first stage can be conducted using a trapping polymerase. In some embodiments, the second stage generally comprises polymerase-catalyzed nucleotide incorporation using a stepping polymerase.

The present disclosure provides mutant polymerases that can be used for conducting trapping or stepping events for nucleic acid sequencing. Some of the mutant polymerases can be used for both trapping and stepping events.

The present disclosure provides mutant polymerases that can be used for trapping a multivalent molecule which comprises a complexed mutant polymerase binding to a multivalent molecule having a complementary nucleotide unit (e.g., exemplary multivalent molecules are shown in FIGS. 2-5). In some embodiments, the multivalent molecule comprises a central core attached to multiple polymer arms each having a nucleotide unit at the end of the arms. The multivalent molecule can be labeled with a detectable reporter moiety. The complexed mutant polymerase includes a mutant polymerase bound to a template/primer duplex. The mutant polymerases are engineered to exhibit reduced sequence-specific errors that occur after certain motif sequences in the primer strand and/or template strand. The sequence-specific errors for a trapping polymerase may be characterized by a substantial loss of signal intensity which leads to a base miscall (e.g., base substitution) or no call at a specific sequencing cycle. The signal often recovers in the next cycle. The motif sequences that lead to the miscalls are specific to a given polymerase and can occur on either template strand in the forward or reverse sequencing direction.

The present disclosure provides mutant polymerases that can be used for binding a complementary nucleotide (e.g., a non-conjugated nucleotide) and incorporating the nucleotide into the 3' end of the primer which is called the stepping event. The mutant polymerases are engineered to exhibit reduced sequence-specific errors which are characterized by substantial loss of nucleotide incorporation that occur after certain motif sequences in the primer strand and/or the template strand. Sequence-specific errors for a stepping enzyme may be characterized by massive phasing after the sequence motif. The motif sequences that lead to phasing are specific to a given polymerase and can occur on either template strand in the forward or reverse sequencing direction.

Without wishing to be bound by theory, it is postulated that mutant polymerases that exhibit trapping sequence-specific errors at certain sequence motifs during sequencing switch from a nucleotide incorporation conformation to an editing conformation. The editing conformation occludes binding of a complementary nucleotide unit from a multivalent molecule during a trapping event which leads to a reduction in signal intensity. Designing a polymerase carrying one or more mutation sites that reduce switching conformations from nucleotide incorporation to editing can reduce trapping sequence-specific errors.

In some embodiments, the mutant polymerases comprise polypeptides, or fragments thereof, derived from directed evolution of recently identified novel B-family and A-family polymerases, where the mutant polymerases exhibit improvements in their specificity while maintaining high discrimination for the correct Watson-crick base-pairing.

The present disclosure provides polymerases that have been engineered to include substitution mutations, including polymerases having amino acid sequence backbones of RLF 89458.1 (e.g., from Thermococci archaeon, isolate B13_G1) (SEQ ID NO:1), RLF 78286.1 (e.g., from Thermococci archaeon, isolate B89_G9) (SEQ ID NO:2), NOZ 58130.1 (e.g., from Euryarchaeota archaeon, isolate M BaxBin.100) (SEQ ID NO:1316), RMF 90817.1 (e.g., from Euryarchaeota archaeon, isolate J060) (SEQ ID NO:2215), MBC 7218772.1 (e.g., from Hadesarchaea archaeon, isolate MAG-18) (SEQ ID NO:2367), WP 175059460.1 (e.g., from Thermococcus sp. 2319x1) (SEQ ID NO:2393), KUO 42443.1 (e.g., from Candidatus Hadarchaem, yellowstonense, isolate YNP_45) (SEQ ID NO:2408), and NOZ 77387.1 (e.g., from Euryarchaeota archaeon, isolate M_MaxBin.027) (SEQ ID NO:2436).

Polypeptides described herein include but are not limited to polypeptides possessing enzymatic activity, such as polymerase activity, and are often described as families. Often, polymerases are DNA polymerases, RNA polymerases, template-independent polymerases, reverse transcriptases, or other enzymes capable of nucleotide binding and nucleotide incorporation (e.g., primer extension). Many DNA polymerases are known in the art, and such enzymes in some instances are mutated to generate the compositions described herein. Members of the DNA polymerase family are often defined in terms of polymerase activity, active site structure, domain homology/function, or sequence homology to other known DNA polymerase family members. For example, DNA polymerases include but are not limited to *E. coli* DNA polymerase I, *E. coli* DNA polymerase II, or other members of the DNA polymerase family. Known thermostable DNA polymerases include Taq polymerase, Pfu polymerase, and 9° N polymerase or other members of the DNA polymerase family. Wild-type DNA polymerases are or may be obtained from any number of origins, such as eukaryotic, prokaryotic, or viral origins, and in some embodiments for purposes of the present disclosure, from archaeal origins. In some embodiments, polymerases comprising amino acid sequences of any of SEQ ID NOS: 3-1315, 1317-2214, 2216-2366, 2368-2392, 2394-2407, 2409-2435, 2437-2454, 2456-2501 and 2511-2523 are members of a DNA polymerase family.

The polymerases described herein can include mutation of the LYP motif can increase the thermal stability of the polymerase to about 72° C., or about 73° C., or about 74° C., or about 75° C., or about 76° C., or about 77° C., or about 78° C., or about 79° C., or about 80° C., or higher temperatures. Many of the engineered polymerases described herein exhibit nucleotide binding and incorporation activity at a temperature range of about 25-50° C., or about 45-75° C., or about 65-80° C. Thus, these engineered polymerases are thermal stable a moderately high temperature ranges (e.g., mesothermal polymerase). The engineered polymerases described herein are suitable for conducting nucleotide binding, nucleotide unit binding, nucleotide incorporation and/or nucleic acid sequencing reactions at a temperature range of about 25-50° C., or about 45-75° C., or about 65-80° C., or higher temperatures. In some embodiments, the mutant polymerases exhibit increased thermal stability by about 2-4° C., or about 4-6° C., or about 6-8° C., or about 8-10° C.

By contrast, DNA polymerases exhibiting significantly higher thermal stability that exceeds 95° C. include 9° N, THERMINATOR, VENT, DEEP VENT, Pfu and *Pyrococcus abyssi*. Thermostable polymerases, such as for example 9° N, VENT, DEEP VENT, Pfu and *Pyrococcus abyssi* polymerases, are suitable for use in a PCR reaction where typical cycling steps are conducted at temperatures that exceed 90-95° C. or higher temperatures, and may not be suitable for use in a nucleotide binding, nucleotide incorporation, and/or nucleic acid sequencing reactions, that are conducted at lower temperature ranges. DNA polymerase from Geobacillus stearothermophilus (e.g., Bst DNA polymerase) is typically stable up to 65° C.

Polymerases variously comprise DNA polymerases, RNA polymerases, template-independent polymerases, reverse transcriptases, or other enzymes capable of catalyzing nucleotide incorporation. Archaeal polymerases are often derived from thermophilic organisms, and thus can represent classes of thermostable or thermotolerant enzymes. Therefore, polypeptide backbones derived from archaeal polymerases provide desirable protein engineering targets to further enhance reversible terminator nucleotide incorporation for applications that may be improved by the application of enzymes with enhanced thermostability or otherwise enhanced resistance to degradation such as by repeated exposure to high temperatures, changes in buffer conditions, and the like.

The present disclosure provides compositions and methods comprising mutant polymerase enzymes that exhibit improved ability to bind complementary nucleotide units of multivalent molecules. Multivalent molecules generally comprises a central moiety (e.g., a core) attached to a plurality of arms where each arm is attached to a nucleotide unit. The multivalent molecules comprise a star, comb, cross-linked, bottle brush, or dendrimer configuration (e.g., see FIG. 2).

We made the surprising discovery that many of the engineered polymerases described herein exhibit enhanced incorporation rate of nucleotide analogs compared to wild type polymerases. Compared to wild type polymerase, some of the engineered polymerases exhibited one or more desirable characteristics, including increased binding affinity to nucleotide analogs having a 3' chain terminating group, improved ability to incorporate a dATP nucleotide opposite a uracil-containing template molecule (e.g., uracil-tolerant mutant polymerases), improved ability to bind complementary nucleotide units of multivalent molecules, increased thermal stability up to approximately 80° C., and reduced sequence-specific errors.

The present disclosure provides compositions and methods comprising mutant polypeptides relating to polymerase enzymes that exhibit increased capacity for binding and discrimination of nucleotide analogs, and improved incorporation of nucleotide analogs compared to a corresponding wild type polymerase. The nucleotide analogs include for example nucleotides comprising a chain terminating group attached to the sugar 2' or 3' position. The chain terminating group comprises an azide, azido or azidomethyl group, or another type of chain terminating group. The engineered DNA polymerases exhibit increased incorporation rate of nucleotide analogs, compared to a corresponding wild type polymerase having an amino acid sequence backbone of any of RLF 78286.1 (SEQ ID NO:1), RLF 78286 (SEQ ID NO:2), NOZ 58130 (SEQ ID NO:1316), RMF 90817 (SEQ ID NO:2215), MBC 7218772 (SEQ ID NO:2367), WP 175059460 (SEQ ID NO:2393), KUO 42443 (SEQ ID NO:2408) or NOZ 77387 (SEQ ID NO:2436). The data shown in Tables 1, 4, 7, 9, and 12 provide numerous exemplary mutant polymerases that exhibit increased incorporation rate of nucleotide analogs compared to their corresponding wild type polymerases. Many of these mutant polymerases include mutations at the LYP motif. In some embodiments, the mutant polymerases exhibit increased incorporation rates of nucleotide analogs by about 5%, 10%, 20%, 30%, 40%, 50%, 60%, 70%, 80%, 90%, 100%, 150%, 200%, 250%, 300%, 500%, or 1000% relative to a corresponding wild type enzyme or enzyme variants currently known in the art. Exemplary mutant polymerase that exhibit increased incorporation rates of nucleotide analogs are listed in Tables 1, 4, 7, 9 and 12.

The present disclosure provides compositions and methods comprising mutant polymerase enzymes that can be used for sequencing a uracil-containing nucleic acid template molecule. The mutant polymerases can exhibit uracil-tolerance having increased ability to incorporate dATP into the 3' end of a nucleic acid primer at a position that is opposite a uracil base in a nucleic acid template molecule. The mutant polymerases may also be capable of binding an adenine-bearing nucleotide unit of a multivalent molecule at a position that is opposite a uracil base in the nucleic acid template molecule. Mutant polymerases having a backbone sequence of RLF 89458 or RLF 78286 (e.g., SEQ ID NOS:1 or 2 respectively) that are uracil-tolerant may comprise a mutation at V93. Other uracil-tolerant mutant polymerases having a backbone sequence of NOZ 58130 (SEQ ID NO:1316), RMF 90817 (SEQ ID NO:2215), MBC 7218772 (SEQ ID NO:2367), WP 175059460 (SEQ ID NO:2393), KUO 42443 (SEQ ID NO:2408) or NOZ 77387 (SEQ ID NO:2436) may include a mutation that is positionally equivalent to V93 in RLF 89458 (SEQ ID NO:1). FIG. 44 shows a sequence alignment of these various polymerases and their positionally equivalent amino acid residues.

Sites that confer certain activities to a polypeptide may be conserved and can be located by aligning the amino acid sequences of various polymerases. For example, certain residues that are associated with polymerase activity (e.g., nucleotide incorporation) can be found at: residues D405, D539 and/or D541 of a polymerase having a backbone sequence of RLF 89458.1 (SEQ ID NO:1); or at residues D405, D539 and/or D541 of a polymerase having a backbone sequence of RLF 78286.1 (SEQ ID NO:2); or at residues D436, D570 and/or D572 of a polymerase having a backbone sequence of NOZ 58130 (SEQ ID NO:1316); or at residues D417, D551 and/or D553 of a polymerase having a backbone sequence of RMF 90817 (SEQ ID NO:2215); or at residues D447, D585 and/or D587 of a polymerase having a backbone sequence of MBC 7218772 (SEQ ID NO:2367); or at residues D407, D543 and/or D545 of a polymerase having a backbone sequence of WP 175059460 (SEQ ID NO:2393); or at residues D444, D582 and/or D584 of a polymerase having a backbone sequence of KUO 42443 (SEQ ID NO:2408); or at residues D428, D562 and/or D564 of a polymerase having a backbone sequence of NOZ 77387 (SEQ ID NO:2436).

The skilled artisan can locate these sites and other functional equivalent sites in other polymerase by reviewing the sequence alignments shown in FIG. 44. Such sites are often found at analogous positions in other regions and domains and polypeptides that comprise such domains are consistent with methods and compositions described herein.

Mutations in the polymerases described herein variously comprise one or more changes to amino acid residues present in the polypeptide. Additions, substitutions, deletions and/or truncations are all examples of mutations that are used to generate mutant polypeptides. Substitutions in some embodiments comprise the exchange of one amino acid for an alternative amino acid, and such alternative amino acids differ from the original amino acid with regard to size, shape, conformation, and/or chemical structure. Mutations in some embodiments are conservative or non-conservative. Conservative mutations comprise the substitution of an amino acid with an amino acid that possesses similar chemical properties. Additions often comprise the insertion of one or more amino acids at the N-terminal, C-terminal, or internal positions of the polypeptide. In some cases, additions comprise fusion polypeptides, wherein one or more additional polypeptides is connected to the polypeptide. Such additional polypeptides in some embodiments comprise domains with additional activity, or sequences with additional function (e.g., improve expression, aid purification, improve solubility, attach to a solid support, or other function). Often a polypeptide described herein comprises one or more non-amino acid groups. Fusion polypeptides optionally comprise an amino acid or other chemical linker that connects the one or more proteins. Any number of mutations can be introduced into a polypeptide or portion of a polypeptide described herein such as 1, 2, 3, 4, 5, 6, 7, 8, 9, 10, 20, 50, or more than 50 mutations.

In some embodiments, entire domains (portions of the polypeptide with a defined function) are added, deleted or substituted with domains from other polypeptides. Exemplary domains include DNA/RNA binding domains, nucleotide binding domains, nuclease domains, subcellular localization domains such as nuclear localization domains, or other domains. In some embodiments, the methods and compositions of the present disclosure comprise the attachment of a domain serving as a spacer or label, and/or providing for the attachment of a linker such as a SNAP tag, an avidin moiety, a streptavidin moiety, an epitope tag, a fluorescent protein, an affinity tag, a metal binding (i.e., a His6 or polyhistidine tag) or the like. In some embodiments, one or more mutations are present at any location, for example in an exonuclease domain, a nucleic acid binding domain, a nucleotide binding domain and/or a catalytic site. The polypeptide comprises at least one mutation and can be based on a wild type backbone sequence of any of SEQ ID NOS:1, 2, 1316, 2215, 2367, 2393, 2408 or 2436.

As used herein, the term "surrounding" an amino acid residue or sequence position has its ordinary meaning in the art, including and incorporating modifications such as substitutions, deletions, insertions, or post-translational modifications at residues from 1, 2, 3, 4, 5, 6, 7, 8, 9, 10, 11, or 12 or more residues distant from the named residue, i.e., N-terminal or C-terminal from the named residue. In some contexts, a residue greater than 12 residues or sequence positions N or C terminal from the named residue can be considered "surrounding" a named residue based on the sequence or structural (i.e., 3-dimensional) context as would be understood by one of ordinary skill in the art.

It is understood that substitutions or modifications of the residues described herein also may incorporate or may include nonstandard amino acids as are known in the art, including but not limited to hydroxyproline, N-formylmethionine, selenomethionine, selenocysteine, phosphotyrosine, phosphohistidine, and the like. The mutations, modifications, truncations, substitutions and the like as described herein may be made by any method as is known in the art, particularly the art of molecular biology and/or protein engineering. Such methods may include site directed mutagenesis using mutagenic and/or partially degenerate primers, in vitro gene assembly, gene editing (such as by CRISPR or related methods) and the like. The mutant or engineered proteins described herein may additionally be expressed, isolated, and/or purified by any such means as is known in the art. Relevant methods are described in: Green, M. and Sambrook, J., Molecular Cloning: A Laboratory Manual (Fourth Edition) which is hereby incorporated by reference in its entirety and especially with respect to its disclosure of methods for modifying, transferring, and expressing, recombinant, modified, and engineered gene sequences as well as extracting, isolating, and/or purifying engineered proteins.

The polypeptides disclosed herein have been shown to function as nucleotide polymerases that exhibit higher thermostability and higher rates of incorporation of 3'-O-azidomethyl derivatized nucleosides, increased uracil-tolerance and/or improved binding to complementary nucleotide units of a multivalent molecule, compared to their corresponding wild type enzymes. The polypeptides disclosed herein may be used for the elongation of a nucleic acid during replication or synthesis, or may trap/bind a nucleotide at the site of nucleotide addition by, for example, use of a non-incorporable or blocked nucleotide, or can be used under conditions in which a required salt or cofactor is absent. The polypeptides disclosed herein may be utilized, for example, in polynucleotides sequencing applications such as, for example, sequencing by synthesis and sequencing by binding applications. Disclosed herein are mutant polymerases comprising at least 70%, 75%, 80%, 85%, 90%, 91%, 92%, 93%, 94%, 95%, 96%, 97%, 98%, 99%, or greater than 99% sequence identity to any of SEQ ID NOS: 3-1315, 1317-2214, 2216-2366, 2368-2392, 2394-2407, 2409-2435, 2437-2454, 2456-2501 or 2511-2523.

The present disclosure provides engineered DNA polymerases comprising the amino acid sequence backbone of a family-B or family-A polymerase which typically include replicative polymerases that exhibit high fidelity. Examples of family-B type polymerases include family-B archaeal DNA polymerases and Phi29 polymerase. In some embodiments, engineered DNA polymerases comprise family-B archaeal DNA polymerases which can be selected from Thermococcus, Thermoplasmata, Pyrococcus, Methanococcus, Hadesarchaea, Euryarchaeota, or Candidatus. In some embodiments, engineered DNA polymerases that are family-B polymerases comprise the amino acid sequence backbone from 9° N polymerase (including THERMINATOR polymerase), VENT polymerase, DEEP VENT polymerase, Pfu polymerase or *Pyrococcus abyssi* polymerase. In some embodiments, engineered DNA polymerases that are family-A polymerases comprise the amino acid sequence backbone of Geobacillus stearothermophilus (e.g., Bst DNA polymerase).

Engineered DNA polymerases can be designed and prepared by introducing one or more mutations into the amino acid sequence of a DNA polymerase of interest and the resulting phenotype of the engineered polymerase can be determined. Any one or any combination of two or more mutation sites can be transferred from one type of polymerase to a positionally equivalent site (or functionally equivalent site) in a second type of polymerase. For example, any one or any combination of two or more mutation sites from a DNA polymerase comprising any one of SEQ ID NOS: 3-1315, 1317-2214, 2216-2366, 2368-2392, 2394-2407, 2409-2435, 2437-2454, 2456-2501 or 2511-2523 can be introduced into a positionally equivalent site (or functionally equivalent site) in a Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509), RB69 polymerase (SEQ ID NO:2510) or Phi29 (SEQ ID NO:2455). Exemplary sequence alignments are provided in FIGS. 44-51. The mutations include any one or any combination of two or more amino acid substitutions, insertions, deletions and/or truncations.

Functional equivalents of a residue comprise one or more amino acid residues that occupy a similar position in the sequence (e.g., sequence alignment) and/or three-dimensional structure of an enzyme (e.g., DNA polymerase), and performs substantially the same function as a known amino acid residue in a known enzyme. A functionally equivalent amino acid substitution includes one or more amino acid residues at a particular position in a basis polypeptide that has the same functional role in another polypeptide. A functionally equivalent amino acid substitution includes any one or any combination of conservative and/or non-conservative amino acid substitutions. Sequence alignments are provided in FIGS. 44-50, which list examples of amino acid residues at sites in a DNA polymerase having a backbone sequence of any of SEQ ID NOS: 1, 2, 1316, 2215, 2367, 2393, 2408 or 2436, and functionally equivalent amino acid sites in Geobacillus stearothermophilus (e.g., Bst DNA polymerase) (SEQ ID NO:2502), 9° N DNA polymerase (relative to SEQ ID NO:2372 or 2373), Pfu DNA polymerase (relative to SEQ ID NO:2508) or *Pyrococcus abyssi* DNA polymerase (relative to SEQ ID NO:2509).

Wild type polypeptide sequences are often starting points for protein or enzyme engineering to generate mutant polypeptides. In some embodiments, a mutant polypeptide differs from a wild-type polypeptide by at least one amino acid residue. Often a mutant polypeptide differs by at least one amino acid residue from the nearest wild-type polypeptide. In some embodiments, a mutant polypeptide differs from a wild-type polypeptide by at least two amino acid residues. In some embodiments, a mutant polypeptide differs from a wild-type polypeptide by at least three, four, five, six or more amino acid residues. Often, a wild type sequence is the closest wild type sequence, identified by aligning the polypeptide comprising at least one mutation within a wild type sequence. In some embodiments, a wild type polypeptide sequence includes a sequence of a naturally-occurring polypeptide.

An amino acid substitution refers to replacing an amino acid residue at a selected position in a polypeptide with a different amino acid having a similar or different biochemical property, such as similar size, shape, conformation, chemical structure, charge and/or hydrophobicity. The amino acid substitution can be a conservative or non-conservative amino acid replacement. In some embodiments, an amino acid residue at a selected position in a polypeptide can be replaced with an amino acid having a polar side-chain. Examples of amino acids having a polar side-chain include arginine, asparagine, aspartic acid, glutamine, glutamic acid, histidine, lysine, serine and threonine. In some embodiments, an amino acid residue at a selected position in a polypeptide can be replaced with an amino acid having a nonpolar side-chain. Examples of amino acids having a nonpolar side-chain include alanine, cysteine, glycine, isoleucine, leucine, methionine, phenylalanine, prolific, tryptophan, tyrosine and valine. In some embodiments, an amino acid residue at a selected position in a polypeptide can be replaced with an amino acid having a hydrophobic side-chain. Examples of amino acids having a hydrophobic side-chain include glycine, alanine, valine, leucine, isoleucine, proline, phenylalanine, methionine, tyrosine and tryptophan. In some embodiments, an amino acid residue at a selected position in a polypeptide can be replaced with an amino acid having an uncharged side-chain. Examples of amino acids having an uncharged side-chain include glycine, serine, cysteine, asparagine, glutamine, tyrosine, and threonine. In some embodiments, an amino acid residue at a selected position in a polypeptide can be replaced with an amino acid having a positive charged side-chain. Examples of amino acids having a positive charged side-chain include arginine, histidine and lysine. In some embodiments, an amino acid residue at a selected position in a polypeptide can be replaced with an amino acid having a negative charged side-chain. Examples of amino acids having a negative charged side-chain include aspartic acid and glutamic acid.

Exemplary polypeptide mutants described herein are listed in Tables 1-15 (FIGS. 29-43, respectively).

In some embodiments, a polypeptide comprises a backbone sequence of RLF 89458.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:1-1315 and the polypeptide comprises at least one of the mutations listed in Tables 1, 2 and 3 (FIGS. 29, 30 and 31, respectively).

In some embodiments, a polypeptide comprises a backbone sequence of NOZ 58130.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:1316-2214 and the polypeptide comprises at least one of the mutations listed in Tables 4-6 (FIGS. 32-33, respectively).

In some embodiments, a polypeptide comprises a backbone sequence of RMF 90817 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2215-2366 and the polypeptide comprises at least one of the mutations listed in Tables 7 and 8 (FIGS. 35 and 36, respectively).

In some embodiments, a polypeptide comprises a backbone sequence of MBC 7218772.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:23672392 and the polypeptide comprises at least one of the mutations listed in Tables 9 and 10 (FIGS. 37 and 38, respectively).

In some embodiments, a polypeptide comprises a backbone sequence of WP 175059460.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2393-2407 and 2511-2523 and the polypeptide comprises at least one of the mutations listed in Table 11 (FIG. 39).

In some embodiments, a polypeptide comprising a backbone sequence of KUO 42443.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2408-2435 and the polypeptide comprises at least one of the mutations listed in Tables 12 and 13 (FIGS. 40 and 41, respectively).

In some embodiments, a polypeptide comprising a backbone sequence of NOZ 77387.1 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2436-2454 and the polypeptide comprises at least one of the mutations listed in Table 14 (FIG. 42).

In some embodiments, a polypeptide comprising a backbone sequence of Phi29 and having a sequence that has at least 70%, 75%, 80%, 85%, 90%, 91%, 92%, 93%, 94%, 95%, 96%, 97%, 98%, 99%, or greater than 99% sequence identity to any of SEQ ID NOs:2455-2501 and the polypeptide comprises at least one of the mutations listed in Table 15 (FIG. 43).

Additional polypeptides contemplated and disclosed herein comprise a DNA polymerase domain having at least one mutation at a position analogous to at least one of the positions in any of Tables 1-15, in some cases to attain polypeptides having one or more of the mutations indicated in Tables 1-15 at a homologous position.

Further described herein are segments, or portions of a larger polypeptide. Optionally, segments have catalytic activity such as nucleotide incorporation and nucleic acid extension activity, particularly in the context of a reverse transcriptase domain or polymerase domain as described herein. Described herein are polypeptides comprising any full-length or segment derived from any one of SEQ ID NOS:1-2501, and at least one additional residue at the N-terminus or C-terminus (e.g., +1 residue). In some embodiments both the N and C terminus has at least an additional residue, two, three four five, six seven, eight, nine, ten 11, 12, 13, 14, 15, 16, 17, 18, 19, 20, 21, 22, 23, 24, 25, 26, 27, 28, 29, 30, 35, 40, 45, 50, 60, 70, 80, 90, 100, or more than 100 additional residues.

For example, described herein are polypeptides comprising any of one of SEQ ID NOS: 1-2501 (+1 residue), such as an adjacent N-terminal aspartic acid, an adjacent C-terminal arginine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal glutamine, an adjacent C-terminal histidine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal valine, an adjacent C-terminal cysteine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal threonine, an adjacent C-terminal cysteine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal threonine, an adjacent C-terminal cysteine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal aspartic acid, an adjacent C-terminal leucine, or a combination thereof, or additional residues such as residues identified through an alignment of any one of SEQ ID NOS: 1-2501. Described herein are polypeptides comprising any of SEQ ID NOS: 1-2501 (+1 residue), such as an adjacent N-terminal aspartic acid, an adjacent C-terminal arginine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal threonine, an adjacent C-terminal threonine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal threonine, an adjacent C-terminal asparagine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal threonine, an adjacent C-terminal asparagine, or a combination thereof, or additional residues such as residues identified through an alignment of any one of SEQ ID NOS: 1-2501. Described herein are polypeptides comprising any one of SEQ ID NOS: 1-2501 (+1 residue), such as an adjacent N-terminal threonine, an adjacent C-terminal serine, or a combination thereof, or additional residues such as residues identified through an alignment of any one of SEQ ID NOS: 1-2501.

Engineered Polymerases Comprising RLF 89458.1 or RLF 78286.1 Backbone Sequence

The present disclosure provides one or more mutant polymerases comprising a backbone sequence of RLF 89458.1 or RLF 78286.1 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS:11315 (Tables 1-3 and FIGS. 11-12 and 29-31). The amino acid sequences of RLF 89458.1 and RLF 78286.1 differ by an amino acid substitution at position 235, where RLF 78286.1 includes D235E.

In some embodiments, the mutant polymerases have a backbone sequence of RLF 89458.1 (e.g., SEQ ID NO:1) or RLF 78286.1 (SEQ ID NO:2) and comprise at least one amino acid substitution mutation that reduces 3' to 5' exonuclease activity compared to a polymerase that lacks an exo-minus mutation. For example, the mutant polymerases comprise at least one amino acid substitution at positions D141 and/or E143. In some embodiments, the mutant polymerases comprise a mutation D141A, D141V, D141L, D141I, D141F, D141Y, D141N, D141T or D141S. In some embodiments, the mutant polymerases comprise a mutation E143A, E143V, E143L, E143I, E143F, E143Y, E143N, E143T or E143S. In some embodiments, the mutant polymerases comprise any combination of mutations at the D141 and the E143 sites.

In some embodiments, the mutant polymerases have a backbone sequence of RLF 89458.1 (e.g., SEQ ID NO:1) or RLF 78286.1 (SEQ ID NO:2) and comprise at least one amino acid substitution mutations of an LYP motif, for example at positions L409, Y410 and P411. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAG, AAP, AAV, AAI, AGA, AGG, AGI, AGP, AGV, FAA, FAG, FAI, FAP, FAV, FGA, FGG, FGP, FGV, LAG, LAI, LAP, LGG, LGI, LGV, SAA, SAG, SAI, SAV, SGA, SGG, SGI, YAA, YAG, YAI, YAP, YGA, YGG, YGI, YGP, LAA, LAV, LGP, LGA, FGI, SGV, YAV, YGV, SYP, SAP, AAA, SGP, LFP, IFP, VFP, LMP, VMP, IMP, LLP, VLP, ILP, LDP, VDP, IDP, LTP, VTP, ITP, LIP, TIP, NNP, NDP, NAP, SYG and FTA.

In some embodiments, the polymerases comprise an amino acid of any of SEQ ID NOS:1-1315 and having an substitution mutation at position L409 comprises a nonpolar amino acid or polar non-charged amino acid. In some embodiments, the amino acid substitution mutation at position L409 comprises valine, glycine, threonine, alanine, serine, isoleucine, leucine, phenylalanine, tyrosine or methionine.

In some embodiments, the polymerases comprise an amino acid of any of SEQ ID NOS:1-1315 and having an substitution mutation at position Y410 comprises a nonpolar amino acid or a polar uncharged amino acid. In some embodiments, the amino acid substitution mutation at position Y410 comprises threonine, serine, glycine, alanine, valine, isoleucine or tyrosine.

In some embodiments, the polymerases comprise an amino acid of any of SEQ ID NOS:1-1315 and having an substitution mutation at position P411 comprises a polar uncharged amino acid, non-polar amino acid or a positively charged amino acid. In some embodiments, the amino acid substitution mutation at position P411 comprises serine, glycine, alanine, valine, cysteine, lysine, isoleucine, threonine or proline.

The present disclosure provides mutant polymerases having a backbone sequence of RLF 89458.1 (e.g., SEQ ID NO:1) or RLF 78286.1 (SEQ ID NO:2) and comprising amino acid substitution mutations at any one or any combination of positions including D4, D6, Y7, I8, E10, N11, G12, K13, P14, 116, R17, F19, K20, K21, E22, K23, G24, E25, F26, K27, 128, E29, D31,R32, N33, F34, E35, P36, Y37, 138, Y39, A40, L41, L42, E43, D44, D45, E46, S47, 148, E49, D50, 151, K52, K53, 154, T55, R58, G56, E57, R58, H59, G60, K61, K62, V63, 165, 166, R67, V68, E69, K70, V71, K72, K73, K74, F75, L76, G77, E78, P79, 180, E81, V82, W83, K84, L85, V86, F87, H89, P90, Q91, D92, V93, P94, A95, 196, R97, D98, A99, 1100, R101, 5102, H103, P104, A105, V106, R107, E108, I109, F110, E111, Y112, D113, 1114, P115, F116, A117, K118, R119, Y120, L121, 1122, D123, K124, L126, V127, P128, M129, E130, G131, G132, E133, L135, K136, L137, L138, A139, F140, D141, 1142, E143, T144, Y146, H147, Y180, A190, K192, R199, Q196, P203, V205, Y209, G211, N213, F214, F216, Y218, 1219, C223, E224, G227, L228, F230, T231, 1232, G233, R234, 5237, E238, P239, K240, Q242, R243, M244, G245, D246, R247, A249, E251, L258, Y261, P262, V264, R265, T267, 1268, R269, P271, T272, Y273, T274, L275, E276, A277, V278, V282, P283, K285, K286, K287, E288, K289, V290, A292, 1295, E297, A298, K300, 5301, L305, R307, V308, A309, Y311, M313, D315, R317, Y320, E321, P328, M329, E332, L333, G338, Q339, D343, S345, S347, S348, G350, N351, L352, V353, W355, Y356, L357, R359, V360, Y362, N365, L367, P372, G373, E376, Q378, M381, Y385, G388, Y389, E394, G396, A402, Y403, L404, F406, R407, 5408, L409, Y410, P411, 5412, 1413, V415, V419, P421, D422, T423, L424, E427, C428, K429, A434, 1436, R440, K443, G447, F448, 1449, P450, 5451, L453, E454, D455, V463, K464, R465, E475, K468, D472, 1474, Y481, A485, K487, 1488, N491, 5492, Y493, Y494, G495, Q497, Y499, 5506, K507, E508, C509, E511, 5512, V513, T514, G517, R518, H519, 1521, T523, E529, K534, V535, A538, E539, D541, 1547, P552, 5557, K558, A559, K560, K561, L563, H565, E568, K569, G572, M573, E575, E577, L583, G585, F586, V588, T589, K592, 1596, H601, T604, G606, V610, R611, R612, D613, E616, 1617, K619, E620, T621, Q622, A623, K624, V625, L626, E627, Y628, 1629, L630, R631, E632, G633, S634, I635, E636, K637, A638, A639, G640, 1641, V642, V645, V646, E647, D648, L649, A650, N651, Y652, R653, V654, V656, E657, K658, H662, E663, Q664, 1665, T666, R667, E668, K670, D671, Y672, K673, A674, T675, G676, P677, H678, V679, A680, 1681, A682, K683, R684, L685, Q686, A687, R688, G689, 1690, K691, V692, K693, P694, T696, 1698, 5699, V702, L703, K704, G705, 5706, K707, K708, 1709, D711, R712, V713, 1714, L715, F716, D717, E718, D720, S721, 5722, R723, K725, Y726, P728, Y730, Y731, 1732, H733, N734, Q735, V736, P738, A739, V740, L741, R742, 1743, L744, E745, A746, F747, G748, Y749, K750, E751, K752, D753, L754, E755, Y756, Q757, R758, M759, K760, Q761, T762, G763, L764, G765, A766, W767, L768 and/or M770. In some embodiments, the amino acid substitution mutations include D141A and E143A.

In some embodiments, the mutant polymerases have a backbone sequence of RLF 89458.1 (e.g., SEQ ID NO:1) or RLF 78286.1 (SEQ ID NO:2) and comprise amino acid substitution mutations at any one or any combination of positions including D4R, D4A, D6S, D6R, Y7A, Y7F, 185, E10V, E10D, E10K, N115, G125, G12D, G12E, K13E, P14Q, 116T, 116N, 116F, R17H, R17C, F19Y, F195, F19I, K20M, K20E, K21E, E22G, E22V, E22K, K23E, K23M, G24S, E25K, F26L,K27M, I28F, I28N, I28T, E29V, E29D, D31V, R32C, R32S, N33S, F34S, F34I, E35K, E35G, E35D, P36L, P36A, P36G, P36V, P36M, P36F, P36K, Y37N, Y37F, I38T, I38N, Y39F, A40G, A40V, A40T, L41P, L42P, L42Q, E43V, E43K, E43D, D44N, D44G, D45V, E46V, S47N, S47G, S47R, I48V, E49G, E49K, D50V, D50G, D5ON, I51K, I51F, K52I, K52R, K53E, I54T, I54N, I54F, I54K, T55I, T55S, T55A, G56D, G56S, G56V, E57G, E57K, R58C, R58L, R58H, H59L, H59Y, G605, G60D, K61M, K62N, K62E, K62R, V63A, V63I, V63D, I65T, I65V, I65F, I65N, I66V, I66T, I66N, R67C, V68M, E69K, K701, V71I, K72H, K72R, K72V, K73E, K74E, K74R, F75C, L76Q, G77D, G77S, E78K, E78G, E78N, E78S, P79S, 180F, 180N, 180K, 180S, 180R, E81D, E81V, V82A, W83R, K84R, L85V, L85Q, L85A, V86D, V86I, V86A, F87I, F87L, F87C, H89D, H89A, H89Y, P90L, P90S, P90D, P90R, P90A, P90G, P90V, P90M, P90T, P90K, Q91L, Q91H, Q91R, Q91W, Q91A, Q91K, Q91N, Q91P, D92N, D92V, V93A, V93M, V93E, V93F, V93Y, V93G, V93S, V93K, V93T, P94L, P94W, P94Y, P94Q, P94F, P94S, A95V, I96T, I96K, I96S, R97C, R97H, R97S, R97P, R97L, D98E, D98N, D98V, A99T, I100T, R101C, R101H, S102N, S102G, H103R, H103L, H103Q, H103Y, P104T, P104L, A105S, V106A, V106T, R107C, R107S, E108V, I109K, I109N, I109F, F110L, F110S,E111V,E111G, Y112C, D113G,D113Y, 1114T, 1114A, 1114G, 1114V, 1114M, 1114T, 1114K, P115C, P115L, P115S, P115R, P115F, F116L, F116S, F116A, A117T, A117V, A117K, K118M, K118R, R119H, R119S, R119C, R119A, R119G, R119V, R119M, R119T, R119K, R119Y, Y120C, Y120N, L121M, I122V, I122F, I122N, I122D, D123G, D123E, D123N, D123V, K124N, K124E, K124R, L126F, L126P, L126Q, V127M, P128L, P128M, M129I, M129V, M129K, M129L, M129E, E130D, E130G, E130V, E130K, E130T, G131S, G132S, E133K, L135M, L135P, L135Q, K136E, K136R, K136L, L137F, L138P, A139E, F140Y, F140L, F140S, D141A, D141V, D141L, D141I, D141F, D141Y, D141N, D141T, D141S, I142V, I142F, I142A, E143A, E143V, E143L, E143I, E143F, E143Y, E143N, E143T, E143S, T144F, Y146C, Y146A, Y146E, Y146S, H147E, Y180F, A190V, K192L, R199H, Q196R, P203S, V205A, Y209A, Y209E, Y209W, G211S, N213E, N213W, N213Y, F214A, F214E, F214W, F214V, F216L, Y218N, I219V, C223V, C223E, C223S, C223L, C223M, C223A, C223P, C223K, C223N, C223D, E224V, G227S, L228P, F230L, T231I, I232F, G233D, R234C, S237G, S237C, E238S, E238R, P239S, K240S, K240E, Q242N, Q242S, R243E, M244T, M244K, G245D, G245S, G245R, G245A, G245N, G245K, D246R, D246L, D246E, D246V, R247E, R247D, R247S, R247H, A249G, A249V, E251S, E251R, E251A, L258I, L258Q, Y261A, Y261P, Y261T, P262S, P262R, P262L, V264I, V264A, R265D, R265I, T267A, T267F, T267M, T267V, T267W, T267Y, T267I, T267S, I268A, I268F, I268M, I268V, I268W, I268Y, R269L, R269K, R269S, R269T, R269V, R269N, R269H, P271S, T272A, T272Y, T272V, T272S, T272L, T272E, T272C, T272R, T272W, T272N, T272F, T272H, T272K, Y273A, Y273W, T274E, T274W, T274S, L275P, L275M, E276K, A277V, V278M, V282L, V282T, V282G, F283L, K285I, K286E, K287R, E288G, E288K, K289E, K289Q, K289N, V290E, A292N, A292T, A292I, I295N, E297G, A298G, K300S, S301N, L305P, R307C, V308I, V308A, A309S, Y311A, Y311E, Y311W, Y311F, M313I, M313K, M313L, D315A, D315E, D315R, D315W, R317C, Y320F, E321L, P328A, M329L, M329S, M329W, M329A, E332K, E332G, L333A, L333V, L333I, G338D, Q339N, D343E, D343N, D343R, D343A, S345C, S345R, S347N, S347T, S347R, S348C, G350S, N351S, N351Q, L352M, V353Q, V353E, W355R, W355F, Y356N, Y356C, Y356L, L357P, R359H, V360A, V360D, Y362I, Y362E, N365S, L367P, P372S, P372M, G373S, E376K, Q378R, M381I, M381R, Y385E, Y385S, G388S, G388R, Y389R, Y389S, E394G, G396S, A402T, Y403H, Y403L, L404Q, F406Y, F406R, F406I, R407N, R407K, S408A, S408G, L409S, L409F, L409A, L409Y, L409I, L409V, L409T, L409N, Y410A, Y410G, Y410F, Y410M, Y410L, Y410D, Y410T, Y410I, Y410N, Y410V, Y410E, Y410S, Y410L, P411G, P411A, P411I, P411V, P411S, P411T, P411L, S412N, S412A, S412G, I413F, I413V, V415M, V415K, V415R, V415N, V415T, V419I, P421S, D422V, T423I, T423L, L424Q, E427G, C428Y, K429R, A434V, A434D, A434P, I436T, I436F, R440H, K443R, G447D, F448I, F448L, I449N, I449F, P450L, S451N, L453Q, E454D, E454N, E454T, D455N, V463M, K464C, R465C, R465T, E475C, K468R, D472V, D472E, I474C, I474F, I474V, Y481C, Y481A, Y481F, Y481T, Y481V, Y481W, A485S, A485T, A485L, A485V, A485G, A485R, K487M, K487R, K487N, I488A, I488V, I488S, I488T, I488M, N491T, N491S, N491A, N491I, S492G, S492Y, S492D, S492K, S492T, S492N, S492E, Y493T, Y493S, Y493I, Y493F, Y493W, Y494A, Y494N, Y494G, Y494F, Y494W, G495S, Q497H, Q497G, Q497M, Q497N, Y499F, S506C, S506R, S506A, S506L, S506T, K507L, K507E, K507S, E508Q, E508C, C509V, C509Y, C509S, C509M, C509A, C509N, C509D, C509H, C509Q, E511K, E511S, S512R, S512D, S512E, S512H, S512F, S512K, S512W, S512D, V513T, V513I, V513L, V513M, V513F, V513A, V513S, T514A, T514G, T514S, T514V, T514I, T514S, G517A, G517S, G517V, G517T, R518C, H519N, H519Y, I521N, I521T, I521E, I521H, T523I, T523A, E529N, K534N, K534S, K534R, V535N, V535K, V535S, V535R, A538V, D539A, D539G, D539E, D539V, D539L, D539S, D541A, D541G, D541E, I547I, I547T, I547P, P552L, S557C, K558A, A559K, K561N, L653M, H565Y, E568K, K569E, G572S, M573I, E575K, E577D, L583P, G585D, G585A, F586I, V588E, V588T, T589K, K592Q, I596T, H601R, H601I, T604S, G606S, V610D, V610A, V610K, V610S, V610T, R611M, R611E, R612E, R612H, R612F, R612M, R612S, R612N, R612G, R612L, R612I, D613S, D613E, D613R, D613K, D613N, D613Q, D613A, D613V, D613Y, D613F, E616C, E616G, I617V, E619R, K619A, K619S, K619T, K619V, E620D, E620K, E620C, E620V, T621I, T621S, Q622L, A623T, A623C, A623K, K624I, V625F, L626I, E627K, V628L, V628I, I629F, I629C, L630Q, L630M, R631H, R631C, E632G, E632C, G633S, G633D, S634C, I635V, I635N, I635T, E636G, E636K, K637M, A638E, A638V, A638T, A639T, G640D, I641F, I641V, I641A, V642I, V642A, V645E, V645I, V645M, V646A, V646D, E647G, E647D, E647K, D648V, D648C, D648L, D648G, L649Q, A650E, A650V, A650T, A650N, N651S, Y652H, Y652C, Y652M, Y652L, Y652F, R653C, R653H, R653Y, V654M, V656I, E657V, K658R, K658E, K658I, K658L, H662V, E663K, E663R, E663S, E663M, E663Q, E663V, Q664A, Q664L, I665V, I665F, I665P, T666A, R667E, E668G, E668K, E668M, E668A, E668P, E668S, E668R, E688N, E688D, K670E, K670I, K670R, K670S, D671G, D671R, D671Y, D671S, D671A, D671K, D671N, Y672F, K673I, K673Y, K673R, K673S, K673E, A674T, A674V, A674S, T675S, T675I, T675A, G676S, P677L, H678R, H678K, H678Q, V679S, V679M, A680V, A680I, A680D, I681T, A682T, K683R, R684H, L685E, Q686R, Q686C, Q686L, A687C, A687T, A687S, R688S, G689S, G689D, I690V, I690F, K691R, K691V, V692I, K693M, K693V, P694R, T696S, T696I, I698K, S699I, S699G, V702A, V702I, L703P, K704E, K704I, K704N, G705D, S706N, S706C, S706G, K707I, K707G, K707N, K708M, K708R, I709F, I709V, I709L, D711G, R712C, V713I, I714L, L715P, L715Q, F716L, D717N, E718K, E718V, D720V, D720Y, D720E, S721N, S721C, S721G, S722G, R723H, K725E, K725L, K725R, Y726F, P728S, P728L, Y730H, Y731H, I732T, I732F, I732N, H733R, N734Y, N734R, N734P, N734D, N734K, N734T, Q735H, Q735R, V736A, P738L, A739V, V740I, L741A, L741Q, R742K, R742L, R742C, I743V, I743E, L744A, E745V, E745F, A746V, A746G, F747L, F747Y, G748V, G748K, Y749F, Y749E, K750N, E751K, E751D, E751M, K752E, K752L, D753V, D753E, D753G, L754Y, L754S, E755G, E755Q, E755D, E755K, E755Y, Y756C, Y756F, Y756I, Y756R, Y756Q, Y756K, Q757L, Q757H, Q757S, Q757M, R758H, R758A, R758K, M759T, M759S, M759N, Q761L, T762N, G765S, W767H, W767Y, W767F, W767S, M770S, M770T and/or M770N.

In some embodiments, the mutant polymerases have a backbone sequence of RLF 89458.1 (e.g., SEQ ID NO:1) or RLF 78286.1 (SEQ ID NO:2) and comprise an amino acid deletion at any one or any combination of positions including R58(deleted), V93(deleted), and/or E755(deleted).

In some embodiments, the mutant polymerases have a backbone sequence of RLF 89458.1 (e.g., SEQ ID NO:1) or RLF 78286.1 (SEQ ID NO:2) and comprise a truncation at an amino acid position including K464(truncated), R465(truncated), E475(truncated), Y481(truncated), E616(truncated), E620(truncated), E755(truncated), Y756(truncated), Q757(truncated), R758(truncated), M759(truncated), T762(truncated), W767(truncated) or M770(truncated). Truncated polymerases can exhibit increase thermal stability compared to a non-truncated polymerase having the same backbone sequence. In Tables 1-15, a truncation is designated with a "^".

In some embodiments, the polymerases comprise an amino acid of any of SEQ ID NOS:1-1315 and having an substitution mutation at position Y7. In some embodiments, the amino acid substitution at position Y7 comprises any of the 20 natural amino acids (i.e., W, I, M, P, F, G, A, V, L, H, R, K, D, E, N, C, S, T, or Q) or with non-natural amino acids as are known to those of skill in the art.

In some embodiments, the polymerases comprise an amino acid of any of SEQ ID NOS:1-1315 and having an substitution mutation at position V93. In some embodiments, the amino acid substitution at position V93 comprises any of the 20 natural amino acids (i.e., W, I, M, P, F, G, A, L, H, R, K, D, E, N, Y, C, S, T, or Q) or with non-natural amino acids as are known to those of skill in the art.

In some embodiments, the polymerases comprise an amino acid of any of SEQ ID NOS:1-1315 and having an substitution mutation at position Y261. In some embodiments, the amino acid substitution at position Y261 comprises any of the 20 natural amino acids (i.e., W, I, M, P, F, G, A, V, L, H, R, K, D, E, N, C, S, T, or Q) or with non-natural amino acids as are known to those of skill in the art.

In some embodiments, the polymerases comprise an amino acid of any of SEQ ID NOS:1-1315 and having an substitution mutation at position T267. In some embodiments, the amino acid substitution at position T267 comprises any of the 20 natural amino acids (i.e., W, I, M, P, F, G, A, V, L, H, R, K, D, E, N, Y, C, S or Q) or with non-natural amino acids as are known to those of skill in the art.

In some embodiments, the polymerases comprise an amino acid of any of SEQ ID NOS:1-1315 and having an substitution mutation at position 1268. In some embodiments, the amino acid substitution at position 1268 comprises any of the 20 natural amino acids (i.e., W, M, P, F, G, A, V, L, H, R, K, D, E, N, Y, C, S, T, or Q) or with non-natural amino acids as are known to those of skill in the art.

In some embodiments, the polymerases comprise an amino acid of any of SEQ ID NOS:1-1315 and having an substitution mutation at position A485. In some embodiments, the amino acid substitution at position A485 comprises any of the 20 natural amino acids (i.e., W, I, M, P, F, G, V, L, H, R, K, D, E, N, Y, C, S, T, or Q) or with non-natural amino acids as are known to those of skill in the art.

In some embodiments, the polymerases comprise an amino acid of any of SEQ ID NOS:1-1315 and having an substitution mutation at position T514. In some embodiments, the amino acid substitution at position T514 comprises any of the 20 natural amino acids (i.e., W, I, M, P, F, G, A, V, L, H, R, K, D, E, N, Y, C, S or Q) or with non-natural amino acids as are known to those of skill in the art.

In some embodiments, the polymerases comprise an amino acid of any of SEQ ID NOS:1-1315 and having an substitution mutation at position D671. In some embodiments, the amino acid substitution at position D671 comprises any of the 20 natural amino acids (i.e., W, I, M, P, F, G, A, V, L, H, R, K, E, N, Y, C, S, T, or Q) or with non-natural amino acids as are known to those of skill in the art.

Engineered Polymerases Comprising NOZ 58130.1 Backbone Sequence

The present disclosure provides one or more mutant polymerases comprising a backbone sequence of NOZ 58130.1 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS:1316-2214 (Tables 4-6 and FIGS. 13 and 32-34).

In some embodiments, the mutant polymerases have a backbone sequence of NOZ 58130.1 (e.g., any of SEQ ID NO:1316-2214) and comprise at least one amino acid substitution mutation that reduces 3' to 5' exonuclease activity compared to a polymerase that lacks an exo-minus mutation. For example, the mutant polymerases comprise at least one amino acid substitution at positions D168 and/or E170. In some embodiments, the mutant polymerases comprise a mutation D168A, D168V, D168L, D168I, D168F, D168Y, D168N, D168T or D168S. In some embodiments, the mutant polymerases comprise a mutation E170A, E170V, E170L, E170I, E170F, E170Y, E170N, E170T or E170S. In some embodiments, the mutant polymerases comprise any combination of mutations at the D168 and the E170 sites.

In some embodiments, the mutant polymerases have a backbone sequence of NOZ 58130.1 (e.g., any of SEQ ID NO:1316-2214) and comprise at least one amino acid substitution mutations of an LYP motif, for example at positions L440, Y441 and P442. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include YAG, FAG, YGP, YAP, FGP, SAP, AAA, YGA, YAA, FGA, FTA, AAG, AAP, AAV, AAI, AGA, AGG, AGI, AGP, AGV, FAA, FAI, FAP, FAV, FGG, FGV, LAG, LAI, LAP, LGG, LGI, LGV, SAA, SAG, SAI, SAV, SGA, SGG, SGI, YAI, YGG, YGI, LAA, LAV, LGP, LGA, FGI, SGV, YAV, YGV, SYP, SGP, LFP, IFP, VFP, LMP, VMP, IMP, LLP, VLP, ILP, LDP, VDP, IDP, LTP, VTP, ITP, LIP, TIP, NNP, NDP, NAP and SYG.

In some embodiments, the polymerases comprise an amino acid of any of SEQ ID NOS:1316-2214 and having an substitution mutation at position L440 comprises a nonpolar amino acid or polar non-charged amino acid. In some embodiments, the amino acid substitution mutation at position L440 comprises valine, glycine, threonine, alanine, serine, isoleucine, leucine, phenylalanine, tyrosine or methionine.

In some embodiments, the polymerases comprise an amino acid of any of SEQ ID NOS:1316-2214 and having an substitution mutation at position Y441 comprises a nonpolar amino acid or a polar uncharged amino acid. In some embodiments, the amino acid substitution mutation at position Y441 comprises threonine, serine, glycine, alanine, valine, isoleucine or tyrosine.

In some embodiments, the polymerases comprise an amino acid of any of SEQ ID NOS:1316-2214 and having an substitution mutation at position P442 comprises a polar uncharged amino acid, non-polar amino acid or a positively charged amino acid. In some embodiments, the amino acid substitution mutation at position P442 comprises serine, glycine, alanine, valine, cysteine, lysine, isoleucine, threonine or proline.

The present disclosure provides mutant polymerases having a backbone sequence of NOZ 58130.1 (e.g., SEQ ID NO:1316) and comprising amino acid substitution mutations at any one or any combination of positions including Y14, E18, F26, G29, F34, V35, V36, F41, S42, P43, F45, P49, R55, L61, A62, S63, A65, E67, 169, K71, V72, E76, K77, T82, P83, R84, V85, T90, V91, S92, H93, P94, Q95, D96, V97, P98, R99, 1100, R101, E102, R103, R105, D111, 1113, E115, H116, D117, 1118, V121, R122, R123, 1126, P132, L133, W135, R150, E153, E157, E158, R163, V164, A165, D168, 1169, E170, V171, L253, G275, A276, L277, V288, L290, Y291, P292, V298, L313, K319, D321, F326, T327, D330, E331, L338, A352, C362, A376, M378, V384, L387, T393, E407, Y408, A409, R413, R422, V434, D436, F437, 5439, L440, Y441, P442, 5443, 1444, 1445, V446, T454, A465, F479, 1480, R496, F511, A515, 5522, F523, Y524, M527, R537, E538, C539, E541, V543, A544, A547, M549, 1551, M555, E559, E565, V566, D570, D572, 1578, L585, A586, Q587, E595, V615, T616, R619, K628, K650, 1655, A665, E674, R675, R677, D685, T690, 5698, 5701, E703, V707, E718, M723, K734, G735, S737, Q738, D752, D758, N759, R767, I772, Y774, L779, K780, E781, G782, I783, T784, Q785, T786, S787, L788, S789, R790, W791 and/or F792. In some embodiments, the amino acid substitution mutations include D168A and E170A.

In some embodiments, the mutant polymerases have a backbone sequence of NOZ 58130.1 (e.g., SEQ ID NO:1316) and comprise amino acid substitution mutations at any one or any combination of positions including Y14F, Y14D, Y14I, Y14N, E18S, E18N, F26Y, F26S, F26I, G29E, G29K, V35M, V35K, V36F, V36N, V36T, V36I, F41S, F41I, S42K, 542G, S42D, S42E, P43L, P43A, P43G, P43V, P43M, P43T, P43K, F45T, F45N, F45I, P49V, P49K, P49D, P49E, R55G, R55K, R55E, L61I, L61S, L61A, L61T, A62D, A62S, A62V, A62G, 563G, S63K, S63E, A65L, A65Y, A65H, E67M, E67K, I69A, I69D, I69V, K71T, K71V, K71F, K71N, K71I, V72T, V72N, V72I, E76Q, E76N, K77E, T82K, T82G, T82N, T82S, T82E, P83R, R84N, R84K, R84S, V85R, T90D, T90I, T90A, T90V, V91I, V91L, V91C, V91F, H93D, H93A, H93Y, P94L, P94S, P94D, P94R, P94A, P94G, P94V, P94M, P94T, P94K, Q95L, Q95H, Q95R, Q95W, Q95A, Q95K, Q95N, Q95P, D96N, D96V, V97S, V97A, V97F, V97Y, P98L, P98W, P98Y, P98Q, P98F, P98S, R99V, R99A, I100T, I100K, 100S, R101C, R101H, R101S, R101P, R101L, E102N, E102V, E102D, R103T, R103A, R105C, R105H, D111C, D111S, D111R, I113K, I113N, I113F, E115V, E115G, H116C, H116Y, D117G, D117Y, I118T, I118A, I118G, I118V, I118M, I118T, I118K, V121T, V121K, V121A, R122S, R122M, R122K, R123H, R123S, R123C, R123A, R123G, R123V, R123M, R123T, R123K, R123Y, I126V, I126F, I126N, I126D, P132L, P132M, L133I, L133V, L133K, L133L, L133E, L133M, W135S, W135L, W135R, R150A, R150V, R150L, R150K, R150F, E153A, E153V, E153L, E153K, E153R, E153F, E157A, E157V, E157L, E157K, E157R, E157F, E157D, E157G, E157T, E158S, E158G, R163E, R163L, R163K, V164F, V164L, A165P, A165L, D168A, D168V, D168L, D168I, D168F, D168Y, D168N, D168T, D168S, I169V, I169F, I169A, E170A, E170V, E170L, E170I, E170F, E170Y, E170N, E170T, E170S, V171F, V171T, L253V, L253E, L253C, G275N, G275K, G275S, G275R, A276M, A276N, A276Q, L277R, L277M, V288F, L290I, Y291A, Y291P, P292R, V298I, L313M, K319V, K319R, D321F, F326N, F326T, F326A, T327Q, D330N, D330E, E331N, L338E, A352L, A352E, A352D, A352Q, C362A, C362L, C362I, C362S, C362F, C362Y, C362V, C362P, C362K, C362N, C362D, A376C, A376R, A376S, M378R, M378T, M378A, V384Q, V384E, L387N, L387C, L387Y, E407R, Y408R, A409R, A409Q, R413Q, R413T, R422V, R422T, R422D, V434H, V434L, V434Y, F437Y, F437R, F437I, S439A, S439G, L440, L440Y, L440F, L440S, L440A, Y441, Y441A, Y441G, Y441T, P442, P442G, P442A, S443R, S443N, S443A, S443G, I444F, I445L, I445F, V446M, V446K, V446R, V446N, V446T, T454I, T454L, A465V, A465D, A465P, F479I, F479L, I480F, I480Y, R496T, R496A, R496G, R496C, F511Y, F511L, F511V, A515L, A515S, A515T, A515V, A515G, A515R, S522D, S522K, S522T, S522N, S522E, S522G, S522Y, F523A, F523S, F523T, F523V, F523I, F523Y, Y524A, Y524N, Y524G, Y524F, Y524L, M527H, M527G, M527Q, R537K, R537E, R537G, R537S, R537L, R537S, E538Q, E538C, C539, C539A, C539V, C539L, C539S, C539Y, C539S, E541K, E541S, V543T, V5431, V543A, V543S, V543G, A544G, A544S, A544T, A547G, M549N, M549Y, M549H, I551N, I551T, I551E, I551H, I551L, I551V, I551A, M555Y, M5551, E559N, E559K, E559D, E565N, E565K, E565S, E565R, V566N, V566K, V566S, V566R, D570A, D570G, D570E, D570V, D570L, D570S, D572A, D572G, D572E, I578F, I578T, I578P, L585K, A586K, E595K, V615E, V615T, T616K, R619E, K628R, K628I, K628H, K650T, K650C, K650A, I655L, I655V, A655E, A655V, A655T, E674G, E674D, E674K, R675V, R675C, R675L, R675D, R677E, R677V, R677T, R677N, R677A, D685R, D685E, D685I, D685L, D685K, T690K, T690R, T690S, T690M, T690Q, T690V, T690E, S698D, S698K, S698R, S698G, S698Y, S698D, S701T, S701V, S701A, S701R, S701E, E703R, E703S, V707I, V707D, V707A, E718R, E718V, E718K, M723S, M723I, M723T, M723N, K734I, K734G, K734N, G735M, G735R, G735K, G735S, G735P, G735T, G735E, S737R, S737E, Q738D, Q738S, Q738E, D752Q, D752T, D758N, N759P, N759D, N759K, N759T, N759Y, N759R, R767E, I772L, I772Y, I772F, Y774F, Y774E, L779G, L779Q, L779D, L779K, L779Y, L779E, K780C, K780F, K780I, K780R, K780Q, K780Y, E781L, E781H, E781S, E781M, E781Q, G782H, G782A, G782K, G782R, Q785L, T786N, S789G, W791R and/or F792R.

In some embodiments, the polymerases comprise an amino acid of any of SEQ ID NOS:1316-2214 and having an substitution mutation at position Y14. In some embodiments, the amino acid substitution at position Y14 comprises any of the 20 natural amino acids (i.e., W, I, M, P, F, G, A, V, L, H, R, K, D, E, N, C, S, T, or Q) or with non-natural amino acids as are known to those of skill in the art.

In some embodiments, the polymerases comprise an amino acid of any of SEQ ID NOS:1316-2214 and having an substitution mutation at position V97. In some embodiments, the amino acid substitution at position V97 comprises any of the 20 natural amino acids (i.e., W, I, M, P, F, G, A, L, H, R, K, D, E, N, Y, C, S, T, or Q) or with non-natural amino acids as are known to those of skill in the art.

In some embodiments, the polymerases comprise an amino acid of any of SEQ ID NOS:1316-2214 and having an substitution mutation at position R122. In some embodiments, the amino acid substitution at position R122 comprises any of the 20 natural amino acids (i.e., W, I, M, P, F, G, A, V, L, H, K, D, E, N, Y, C, S, T, or Q) or with non-natural amino acids as are known to those of skill in the art.

In some embodiments, the polymerases comprise an amino acid of any of SEQ ID NOS:1316-2214 and having an substitution mutation at position R150. In some embodiments, the amino acid substitution at position R150 comprises any of the 20 natural amino acids (i.e., W, I, M, P, F, G, A, V, L, H, K, D, E, N, Y, C, S, T, or Q) or with non-natural amino acids as are known to those of skill in the art.

In some embodiments, the polymerases comprise an amino acid of any of SEQ ID NOS:1316-2214 and having an substitution mutation at position C362. In some embodiments, the amino acid substitution at position C362 comprises any of the 20 natural amino acids (i.e., W, I, M, P, F, G, A, V, L, H, R, K, D, E, N, Y, S, T, or Q) or with non-natural amino acids as are known to those of skill in the art.

In some embodiments, the polymerases comprise an amino acid of any of SEQ ID NOS:1316-2214 and having an substitution mutation at position R496. In some embodiments, the amino acid substitution at position R496 comprises any of the 20 natural amino acids (i.e., W, I, M, P, F, G, A, V, L, H, K, D, E, N, Y, C, S, T, or Q) or with non-natural amino acids as are known to those of skill in the art.

In some embodiments, the polymerases comprise an amino acid of any of SEQ ID NOS:1316-2214 and having an substitution mutation at position A515. In some embodiments, the amino acid substitution at position A515 comprises any of the 20 natural amino acids (i.e., W, I, M, P, F, G, V, L, H, R, K, D, E, N, Y, C, S, T, or Q) or with non-natural amino acids as are known to those of skill in the art.

In some embodiments, the polymerases comprise an amino acid of any of SEQ ID NOS:1316-2214 and having an substitution mutation at position R537. In some embodiments, the amino acid substitution at position R537 comprises any of the 20 natural amino acids (i.e., W, I, M, P, F, G, A, V, L, H, K, D, E, N, Y, C, S, T, or Q) or with non-natural amino acids as are known to those of skill in the art.

In some embodiments, the polymerases comprise an amino acid of any of SEQ ID NOS:1316-2214 and having an substitution mutation at position E559. In some embodiments, the amino acid substitution at position E559 comprises any of the 20 natural amino acids (i.e., W, I, M, P, F, G, A, V, L, H, R, K, D, N, Y, C, S, T, or Q) or with non-natural amino acids as are known to those of skill in the art.

In some embodiments, the mutant polymerases have a backbone sequence of NOZ 58130.1 (e.g., any of SEQ ID NO:1316-2214) and comprise an amino acid deletion at any position including D117(deleted).

In some embodiments, the mutant polymerases have a backbone sequence of NOZ 58130.1 (e.g., any of SEQ ID NO:1316-2214) and comprise a truncation at an amino acid position including M723(truncated), G773(truncated), Y774(truncated), D777(truncated), G782(truncated), Q785(truncated), R790(truncated) or F792(truncated). Truncated polymerases can exhibit increase thermal stability compared to a non-truncated polymerase having the same backbone sequence. In Tables 1-15, a truncation is designated with a "^".

Engineered Polymerases Comprising RMF 90817.1 Backbone Sequence

The present disclosure provides one or more mutant polymerases comprising a backbone sequence of RMF 90817.1 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS:2215-2366 (Tables 7-8 and FIGS. 14 and 35-36).

In some embodiments, the mutant polymerases have a backbone sequence of RMF 90817.1 (e.g., SEQ ID NO:2215) and comprise at least one amino acid substitution mutation that reduces 3' to 5' exonuclease activity compared to a polymerase that lacks an exo-minus mutation. For example, the mutant polymerases comprise at least one amino acid substitution at positions D149 and/or E151. In some embodiments, the mutant polymerases comprise a mutation D149A, D149V, D149L, D149I, D149F, D149Y, D149N, D149T or D149S. In some embodiments, the mutant polymerases comprise a mutation E151A, E151V, E151L, E151I, E151F, E151Y, E151N, E151T or E151S. In some embodiments, the mutant polymerases comprise any combination of mutations at the D149 and the E151 sites.

In some embodiments, the mutant polymerases have a backbone sequence of RMF 90817.1 (e.g., SEQ ID NO:2215) and comprise at least one amino acid substitution mutations of an LYP motif, for example at positions L421, Y422 and P423. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, AAG, AGA, AGP, FAA, FAG, FGA, FGP, SAA, SAG, SGA, SGP, YAA, YAG, YGA, YGP, FAP, SAP, YAP, AAP, AGV, AGG, AGI, AAV, AAI, FAI, FAP, FAV, FGG, FGV, LAG, LAI, LAP, LGG, LGI, LGV, FTA, FAV, FGG, FGV, LAG, LAI, LAP, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

In some embodiments, the polymerases comprise an amino acid of any of SEQ ID NOS:2215-2366 and having an substitution mutation at position L421 comprises a nonpolar amino acid or polar non-charged amino acid. In some embodiments, the amino acid substitution mutation at position L421 comprises valine, glycine, threonine, alanine, serine, isoleucine, leucine, phenylalanine, tyrosine or methionine.

In some embodiments, the polymerases comprise an amino acid of any of SEQ ID NOS:2215-2366 and having an substitution mutation at position Y422 comprises a nonpolar amino acid or a polar uncharged amino acid. In some embodiments, the amino acid substitution mutation at position Y422 comprises threonine, serine, glycine, alanine, valine, isoleucine or tyrosine.

In some embodiments, the polymerases comprise an amino acid of any of SEQ ID NOS:2215-2366 and having an substitution mutation at position P423 comprises a polar uncharged amino acid, non-polar amino acid or a positively charged amino acid. In some embodiments, the amino acid substitution mutation at position P423 comprises serine, glycine, alanine, valine, cysteine, lysine, isoleucine, threonine or proline.

The present disclosure provides mutant polymerases having a backbone sequence of RMF 90817.1 (e.g., SEQ ID NO:2215) and comprising amino acid substitution mutations at any one or any combination of positions including Y11, D15, F23, K25, I28, L29, F34, Q35, P36, F38, H43, E49, G55, A56, V57, R62, R67, I75, L76, S77, H78, P79, S80, E81, V82, P83, K84, I85, R86, E87, E88, R90, E96, I98, E100, H101, D102, I103, A106, R108, I111, P117, L118, E138, G139, R144, V145, M146, D149, I150, E151, T152, A234, Y272, C307, R312, E333, A357, V365, L368, F374, L390, V415, D417, F418, S420, L421, Y422, P423, I425, V427, T435, P445, F459, A496, S503, F504, Y505, M508, K518, E519, C520, S523, V524, T525, M530, T532, D551, D553, V559, R566, A567, M568, R576, I596, T597, N609, Q631, V636, A646, N655, R656, K658, D666, T671, R679, N682, K688, E699, M704, G715, L716, N740, L753, Y755, K761, E762, E763, M764, V765, Q766, G767, S768, L769, Q770, R771, W772 and/or F773. In some embodiments, the amino acid substitution mutations include D149A and E151A.

In some embodiments, the mutant polymerases have a backbone sequence of RMF 90817.1 (e.g., SEQ ID NO:2215) and comprise amino acid substitution mutations at any one or any combination of positions including Y11F, Y11A, D15S, F23Y, F23S, F23I, K25E, I28F, I28N, I28T, L29V, L29D, F34S, F34I, Q35K, Q35G, Q35D, P36L, P36A, P36G, P36V, P36M, P36T, P36K, F38T, F38N, H43V, H43K, H43D, E49G, E49K, G55I, G55S, G55A, G55T,A56D, A56S, A56V, A56G,V57A,V57I, V57D, V57M, R62E, R62K,R67K, R67G, R67N, R67S, R67E, I75D, I75A, I75V, L76I, L76C, L76F, S77E, S77N, H78D, H78A, H78Y, P79L, P79S, P79D, P79R, P79A, P79G, P79V, P79M, P79T, P79K, S80L, S8OH, S8OR, S8OW, S80A, S80K, S80N, S80P, S80Q, E81N, E81V, E81D, V82A, V82M, V82E, V82F, V82Y, V82G, V82S, V82K, V82T, P83L, P83W, P83Y, P83Q, P83F, P83S, K84V, K84A, I85T, I85K, I85S, R86C, R86H, R86S, R86P, R86L, E87N, E87V, E87T, E87D, E88T, E88A, R90C, R90H, E96C, E96S, E96R, I98K, I98N, I98F, E100V, E100G, H101C, H101Y, D102G, D102Y, I103T, I103A, I103G, I103V, I103M, I103T, I103K, A106T, A106V, A106K, R108H, R108S, R108C, R108A, R108G, R108V, R108M, R108T, R108K, R108Y, I111V, I111F, I111N, I111D, P117L, P117M, L118I, L118V, L118K, L118E, I118M, E138D, E138G, E138V, E138K, E138T, G139S, R144E, R144L, R144K, V145F, V145L, M146P, M146L, D149A, D149V, D149L, D149I, D149F, D149Y, D149N, D149T, D149S, I150V, I150F, I150A, E151A, E151V, E151L, E151I, E151F, E151Y, E151N, E151T, E151S, T152F, A234V, A234E, A234C, Y272A, Y272P, C307A, C307V, R312S, R312K, E333L, A357C, A357R, A357S, V365Q, V365E, L368N, L368C, L368Y, F374I, F374E, F374Y, L390R, L390Q, V415H, V415L, V415Y, F418Y, F418R, F418I, L421A, L421F, L421S, L421Y, L421I, L421V, L421T, L421N, Y422A, Y422G, Y422F, Y422M, Y422L, Y422D, Y422T, Y422I, Y422N, P423A, P423G, P423I, P423V, I425F, V427M, V427K, V427R, V427N, V427T, T435I, T435L, P445V, P445D, P445A, F459I, F459L, A496L, A496S, A496T, A496V, A496G, A496R, S503G, S503Y, S503D, S503K, S503T, S503N, S503E, F504T, F504S, F504I, F504Y, Y505A, Y505N, Y505G, M508H, M508G, M508Q, K518L, K518E, E519Q, E519C, C520A, C520V, C520Y, C520S, S523A, S523R, V524T, V524I, T525A, T525S, T525G, M530N, M530Y, M530H, T532N, T532E, T532H, D551A, D551G, D551E, D551V, D551L, D551S, D553A, D553G, D553E, V559F, V559T, V559P, V559I, R566A, R566K, A567K, M568N, R576K, R576E, I596E, I596T, I596V, T597K, N609R, N609I, N609H, Q631T, Q631C, Q631K, Q631A, V636L, V636I, A646E, A646V, A646T, N655G, N655D, N655K, N655E, R656V, R656C, R656L, R656D, K658E, K658V, K658T, K658N, K658A, D666R, D666E, D666I, D666L, D666K, T671K, T671R, T671S, T671M, T671Q, T671V, T671E, R679G, R679Y, R679D, N682T, N682V, N682S, N682A, K688V, K688I, K688D, K688A, E699R, E699V, E699K, M704S, M704I, M704T, G715I, G715N, G715K, L716M, L716R, L716K, N740P, N740D, N740K, N740T, N740Y, N740R, L753Y, L753F, Y755F, Y755E, K761G, K761Q, K761D, K761Y, K761E, E762L, E762H, E762S, E762M, E762Q, E763H, E763A, E763K, E763R, M764I, M764V, M764L, M764A, M764K, V765K, V765T, V765S, V765N, V765Q, V765A, V765I, V765L, V765M, Q766L, Q766I, Q766V, Q766A, Q766M, G767N, G767T, S768G, L769I, L769V, L769A, Q770S, Q770G, R771A, W772Y, W772F, F773L and/or F773I.

In some embodiments, the polymerases comprise an amino acid of any of SEQ ID NOS:2215-2366 and having an substitution mutation at position Y11. In some embodiments, the amino acid substitution at position Y11 comprises any of the 20 natural amino acids (i.e., W, I, M, P, F, G, A, V, L, H, R, K, D, E, N, C, S, T, or Q) or with non-natural amino acids as are known to those of skill in the art.

In some embodiments, the polymerases comprise an amino acid of any of SEQ ID NOS:2215-2366 and having an substitution mutation at position Y272. In some embodiments, the amino acid substitution at position Y272 comprises any of the 20 natural amino acids (i.e., W, I, M, P, F, G, A, V, L, H, R, K, D, E, N, C, S, T, or Q) or with non-natural amino acids as are known to those of skill in the art.

In some embodiments, the polymerases comprise an amino acid of any of SEQ ID NOS:2215-2366 and having an substitution mutation at position C307. In some embodiments, the amino acid substitution at position C307 comprises any of the 20 natural amino acids (i.e., W, I, M, P, F, G, A, V, L, H, R, K, D, E, N, Y, S, T, or Q) or with non-natural amino acids as are known to those of skill in the art.

In some embodiments, the polymerases comprise an amino acid of any of SEQ ID NOS:2215-2366 and having an substitution mutation at position A496. In some embodiments, the amino acid substitution at position A496 comprises any of the 20 natural amino acids (i.e., W, I, M, P, F, G, V, L, H, R, K, D, E, N, Y, C, S, T, or Q) or with non-natural amino acids as are known to those of skill in the art.

In some embodiments, the polymerases comprise an amino acid of any of SEQ ID NOS:2215-2366 and having an substitution mutation at position C520. In some embodiments, the amino acid substitution at position C520 comprises any of the 20 natural amino acids (i.e., W, I, M, P, F, G, A, V, L, H, R, K, D, E, N, Y, S, T, or Q) or with non-natural amino acids as are known to those of skill in the art.

In some embodiments, the polymerases comprise an amino acid of any of SEQ ID NOS:2215-2366 and having an substitution mutation at position S523. In some embodiments, the amino acid substitution at position S523 comprises any of the 20 natural amino acids (i.e., W, I, M, P, F, G, A, V, L, H, R, K, D, E, N, Y, C, T, or Q) or with non-natural amino acids as are known to those of skill in the art.

In some embodiments, the polymerases comprise an amino acid of any of SEQ ID NOS:2215-2366 and having an substitution mutation at position T525. In some embodiments, the amino acid substitution at position T525 comprises any of the 20 natural amino acids (i.e., W, I, M, P, F, G, A, V, L, H, R, K, D, E, N, Y, C, S or Q) or with non-natural amino acids as are known to those of skill in the art.

Engineered Polymerases Comprising MBC 7218772.1 Backbone Sequence

The present disclosure provides one or more mutant polymerases comprising a backbone sequence of MBC 7218772.1 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS:2367-2392 (Tables 9-10 and FIGS. 15 and 37-38).

In some embodiments, the mutant polymerases have a backbone sequence of MBC 7218772.1 (e.g., SEQ ID NO:2367) and comprise at least one amino acid substitution mutation that reduces 3' to 5' exonuclease activity compared to a polymerase that lacks an exo-minus mutation. For example, the mutant polymerases comprise at least one amino acid substitution at positions D173 and/or E175. In some embodiments, the mutant polymerases comprise a mutation D173A, D173V, D173L, D173I, D173F, D173Y, D173N, D173T or D173S. In some embodiments, the mutant polymerases comprise a mutation E175A, E175V, E175L, E175I, E175F, E175Y, E175N, E175T or E175S. In some embodiments, the mutant polymerases comprise any combination of mutations at the D173 and the E175 sites.

In some embodiments, the mutant polymerases have a backbone sequence of MBC 7218772.1 (e.g., SEQ ID NO:2367) and comprise at least one amino acid substitution mutations of an LYP motif, for example at positions L451, Y452 and P453. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, AAG, AGA, AGP, FAA, FAG, FGA, FGP, SAA, SAG, SGA, SGP, YAA, YAG, YGA, YGP, FAP, SAP, YAP, AAP, LAP, AGV, AGG, AGI, AAV, AAI, FAI, FTA, FAV, FGG, FGV, LAG, LAI, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

In some embodiments, the polymerases comprise an amino acid of any of SEQ ID NOS:2367-2392 and having an substitution mutation at position L451 comprises a nonpolar amino acid or polar non-charged amino acid. In some embodiments, the amino acid substitution mutation at position L451 comprises valine, glycine, threonine, alanine, serine, isoleucine, leucine, phenylalanine, tyrosine or methionine.

In some embodiments, the polymerases comprise an amino acid of any of SEQ ID NOS:2367-2392 and having an substitution mutation at position Y452 comprises a non-polar amino acid or a polar uncharged amino acid. In some embodiments, the amino acid substitution mutation at position Y452 comprises threonine, serine, glycine, alanine, valine, isoleucine or tyrosine.

In some embodiments, the polymerases comprise an amino acid of any of SEQ ID NOS:2367-2392 and having an substitution mutation at position P453 comprises a polar uncharged amino acid, non-polar amino acid or a positively charged amino acid. In some embodiments, the amino acid substitution mutation at position P453 comprises serine, glycine, alanine, valine, cysteine, lysine, isoleucine, threonine or proline.

In some embodiments, the polymerases comprise an amino acid of any of SEQ ID NOS:2367-2392 and having an substitution mutation at position I10. In some embodiments, the amino acid substitution at position I10 comprises any of the 20 natural amino acids (i.e., W, M, P, F, G, A, V, L, H, R, K, D, E, N, Y, C, S, T, or Q) or with non-natural amino acids as are known to those of skill in the art.

In some embodiments, the polymerases comprise an amino acid of any of SEQ ID NOS:2367-2392 and having an substitution mutation at position C468. In some embodiments, the amino acid substitution at position C468 comprises any of the 20 natural amino acids (i.e., W, I, M, P, F, G, A, V, L, H, R, K, D, E, N, Y, S, T, or Q) or with non-natural amino acids as are known to those of skill in the art.

In some embodiments, the polymerases comprise an amino acid of any of SEQ ID NOS:2367-2392 and having an substitution mutation at position T560. In some embodiments, the amino acid substitution at position T560 comprises any of the 20 natural amino acids (i.e., W, I, M, P, F, G, A, V, L, H, R, K, D, E, N, Y, C, S or Q) or with non-natural amino acids as are known to those of skill in the art.

Engineered Polymerases Comprising WP 175059460.1 Backbone Sequence

The present disclosure provides one or more mutant polymerases comprising a backbone sequence of WP 175059460.1 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS:2393-2407 and 2511-2523 (Table 11 and FIGS. 16 and 39).

In some embodiments, the mutant polymerases have a backbone sequence of WP 175059460.1 (e.g., SEQ ID NO:2393) and comprise at least one amino acid substitution mutation that reduces 3' to 5' exonuclease activity compared to a polymerase that lacks an exo-minus mutation. For example, the mutant polymerases comprise at least one amino acid substitution at positions D141 and/or E143. In some embodiments, the mutant polymerases comprise a mutation D141A, D141V, D141L, D141I, D141F, D141Y, D141N, D141T or D141S. In some embodiments, the mutant polymerases comprise a mutation E143A, E143V, E143L, E143I, E143F, E143Y, E143N, E143T or E143S. In some embodiments, the mutant polymerases comprise any combination of mutations at the D141 and the E143 sites.

In some embodiments, the mutant polymerases have a backbone sequence of WP 175059460.1 (e.g., SEQ ID NO:2393) and comprise at least one amino acid substitution mutations of an LYP motif, for example at positions L451, Y452 and P453. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, AAG, AGA, AGP, FAA, FAG, FGA, FGP, SAA, SAG, SGA, SGP, YAA, YAG, YGA, YGP, FAP, SAP, YAP, AAP, LAP, AGV, AGG, AGI, AAV, AAI, FAI, FTA, FAV, FGG, FGV, LAG, LAI, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

In some embodiments, the polymerases comprise an amino acid of any of SEQ ID NOS:2393-2407 and 2511-2523 and having an substitution mutation at position L451 comprises a nonpolar amino acid or polar non-charged amino acid. In some embodiments, the amino acid substitution mutation at position L451 comprises valine, glycine, threonine, alanine, serine, isoleucine, leucine, phenylalanine, tyrosine or methionine.

In some embodiments, the polymerases comprise an amino acid of any of SEQ ID NOS:2393-2407 and 2511-2523 and having an substitution mutation at position Y452 comprises a non-polar amino acid or a polar uncharged amino acid. In some embodiments, the amino acid substitution mutation at position Y452 comprises threonine, serine, glycine, alanine, valine, isoleucine or tyrosine.

In some embodiments, the polymerases comprise an amino acid of any of SEQ ID NOS:2393-2407 and 2511-2523 and having an substitution mutation at position P453 comprises a polar uncharged amino acid, non-polar amino acid or a positively charged amino acid. In some embodiments, the amino acid substitution mutation at position P453 comprises serine, glycine, alanine, valine, cysteine, lysine, isoleucine, threonine or proline.

The present disclosure provides mutant polymerases having a backbone sequence of WP 175059460.1 (e.g., SEQ ID NO:2393) and comprising amino acid substitution mutations at one or more positions including Y7, D11, I51, K61, V93, A117, M129, D141, I142, E143, T144, A223, E302, E323, D407, F408, S410, L411, Y412, P413, R487, A488, S495, Y496, K510, T517, I524, K562, A563, R564, S572, T593, R605, K652, D675, K695, T700, R712, Y759, Y760, Q761, 5762, 5763, K764, Q765 and/or T766. In some embodiments, the amino acid substitution mutations include D141A and E143A.

In some embodiments, the mutant polymerases have a backbone sequence of WP_175059460.1 (e.g., SEQ ID NO:2393) and comprise amino acid substitution mutations at one or more positions including Y7F, Y7A, Y7V, Y7I, Y7L, Y7M, Y7W, D11K, D11G, D11E, D11N, I51R, I51K, I51H, K61M, K61R, V93Q, V93A, V93I, V93L, V93M, V93F, V93Y, V93W, V93S, V93T, V93N, V93R, V93E, V93K, V93D, A117V, M129A, D141A, D141V, D141L, D141I, D141F, D141Y, D141N, D141T, D141S, I142A, I142G, I142M, I142V, I142L, E143A, E143V, E143L, E143I, E143F, E143Y, E143N, E143T, E143S, T144A, T144K, T144R, A223S, A223C, E302N, E302D, E302K, E323Q, S410A, S410G, S410M, S410V, S410L, S410I, L411A, L411S, L411Q, L411H, L411F, L411Y, Y412A, Y412G, P413G, P413V, P413A, P413I, P413S, P413T, P413L, P413I, A488V, A488S, A488L, S495G, Y496I, Y496V, Y496M, K510I, K510L, K510V, K510R, T517S, T517N, T517Q, T517A, I524H, I524T, I524V, I524S, I524G, I524A, I524L, I524F, K562D, K562N, A563V, R564G, R564E R564K, S572I, S572L, S572S, S572E, T593I, T593L, T593V, R605E, R605K, R605H, K652N, K652D, D675E, K695E, K695D, T700D, T700S, R712G, R712N, R712S, R712K, R759K, R759E, Y760V, Y760G, Q761W, Q761L, S762A, 5762G, S762R, S762T, S762A, K764S, K764A, Q765K and/or Q765W.

In some embodiments, the polymerases comprise an amino acid of any of SEQ ID NOS:2393-2407 and 2511-2523 and having an substitution mutation at position 1228. In some embodiments, the amino acid substitution at position 1228 comprises any of the 20 natural amino acids (i.e., W, M, P, F, G, A, V, L, H, R, K, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position G441. In some embodiments, the amino acid substitution at position G441 comprises any of the 20 natural amino acids (i.e., W, I, M, P, F, A, V, L, H, R, K, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position K443. In some embodiments, the amino acid substitution at position K443 comprises any of the 20 natural amino acids (i.e., W, I, M, P, F, G, A, V, L, H, R, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position A488. In some embodiments, the amino acid substitution at position A488 comprises any of the 20 natural amino acids (i.e., W, I, M, P, F, G, V, L, H, R, K, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position K510. In some embodiments, the amino acid substitution at position K510 comprises any of the 20 natural amino acids (i.e., W, I, M, P, F, G, A, V, L, H, R, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position 1524. In some embodiments, the amino acid substitution at position 1524 comprises any of the 20 natural amino acids (i.e., W, M, P, F, G, A, V, L, H, R, K, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position G710. In some embodiments, the amino acid substitution at position G710 comprises any of the 20 natural amino acids (i.e., W, I, M, P, F, A, V, L, H, R, K, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position R712. In some embodiments, the amino acid substitution at position R712 comprises any of the 20 natural amino acids (i.e., W, I, M, P, F, G, A, V, L, H, K, D, E, N, Y, C, S, T, or Q) or with non-natural amino acids as are known to those of skill in the art.

In some embodiments, the polymerases comprise an amino acid of any of SEQ ID NOS:2393-2407 and 2511-2523 and having an substitution mutation at position A770. In some embodiments, the amino acid substitution at position A770 comprises any of the 20 natural amino acids (i.e., W, I, M, P, F, G, V, L, H, R, K, D, E, N, Y, C, S, T, or Q) or with non-natural amino acids as are known to those of skill in the art.

Engineered Polymerases Comprising KUO 42443.1 Backbone Sequence

The present disclosure provides one or more mutant polymerases comprising a backbone sequence of KUO 42443.1 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS:2408-2435 (Tables 12-13 and FIGS. 17, 40-41).

In some embodiments, the mutant polymerases have a backbone sequence of KUO 42443.1 (e.g., SEQ ID NO:2408) and comprise at least one amino acid substitution mutation that reduces 3' to 5' exonuclease activity compared to a polymerase that lacks an exo-minus mutation. For example, the mutant polymerases comprise at least one amino acid substitution at positions D170 and/or E172. In some embodiments, the mutant polymerases comprise a mutation D170A, D170V, D170L, D170I, D170F, D170Y, D170N, D170T or D170S. In some embodiments, the mutant polymerases comprise a mutation E172A, E172V, E172L, E172I, E172F, E172Y, E172N, E172T or E172S. In some embodiments, the mutant polymerases comprise any combination of mutations at the D170 and the E172 sites.

In some embodiments, the mutant polymerases have a backbone sequence of KUO 42443.1 (e.g., SEQ ID NO:2408) and comprise at least one amino acid substitution mutations of an LYP motif, for example at positions L448, Y449 and P450. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, SAG, SGP, SAP, LAP, AAG, AGA, AGP, FAA, FAG, FGA, FGP, SAA, SGA, YAG, YGA, YGP, FAP, YAP, AAP, YAA, AGV, AGG, AGI, AAV, AAI, FAI, FTA, FAV, FGG, FGV, LAG, LAI, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

In some embodiments, the polymerases comprise an amino acid of any of SEQ ID NOS:2408-2435 and having an substitution mutation at position L448 comprises a nonpolar amino acid or polar non-charged amino acid. In some embodiments, the amino acid substitution mutation at position L448 comprises valine, glycine, threonine, alanine, serine, isoleucine, leucine, phenylalanine, tyrosine or methionine.

In some embodiments, the polymerases comprise an amino acid of any of SEQ ID NOS:2408-2435 and having an substitution mutation at position Y449 comprises a non-polar amino acid or a polar uncharged amino acid. In some embodiments, the amino acid substitution mutation at position Y449 comprises threonine, serine, glycine, alanine, valine, isoleucine or tyrosine.

In some embodiments, the polymerases comprise an amino acid of any of SEQ ID NOS:2408-2435 and having an substitution mutation at position P450 comprises a polar uncharged amino acid, non-polar amino acid or a positively charged amino acid. In some embodiments, the amino acid substitution mutation at position P450 comprises serine, glycine, alanine, valine, cysteine, lysine, isoleucine, threonine or proline.

In some embodiments, the polymerases comprise an amino acid of any of SEQ ID NOS:2408-2435 and having an substitution mutation at position Y7. In some embodiments, the amino acid substitution at position Y7 comprises any of the 20 natural amino acids (i.e., W, I, M, P, F, G, A, V, L, H, R, K, D, E, N, C, S, T, or Q) or with non-natural amino acids as are known to those of skill in the art.

In some embodiments, the polymerases comprise an amino acid of any of SEQ ID NOS:2408-2435 and having an substitution mutation at position D170. In some embodiments, the amino acid substitution at position D170 comprises any of the 20 natural amino acids (i.e., W, I, M, P, F, G, A, V, L, H, R, K, E, N, Y, C, S, T, or Q) or with non-natural amino acids as are known to those of skill in the art.

In some embodiments, the polymerases comprise an amino acid of any of SEQ ID NOS:2408-2435 and having an substitution mutation at position E172. In some embodiments, the amino acid substitution at position E172 comprises any of the 20 natural amino acids (i.e., W, I, M, P, F, G, A, V, L, H, R, K, D, N, Y, C, S, T, or Q) or with non-natural amino acids as are known to those of skill in the art.

In some embodiments, the polymerases comprise an amino acid of any of SEQ ID NOS:2408-2435 and having an substitution mutation at position T557. In some embodiments, the amino acid substitution at position T557 comprises any of the 20 natural amino acids (i.e., W, I, M, P, F, G, A, V, L, H, R, K, D, E, N, Y, C, S or Q) or with non-natural amino acids as are known to those of skill in the art.

In some embodiments, the polymerases comprise an amino acid of any of SEQ ID NOS:2408-2435 and having an substitution mutation at position S558. In some embodiments, the amino acid substitution at position S558 comprises any of the 20 natural amino acids (i.e., W, I, M, P, F, G, A, V, L, H, R, K, D, E, N, Y, C, T, or Q) or with non-natural amino acids as are known to those of skill in the art.

Engineered Polymerases Comprising NOZ 77387.1 Backbone Sequence

The present disclosure provides one or more mutant polymerases comprising a backbone sequence of NOZ 77387.1 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS: 2436-2454 (Table 14 and FIGS. 18 and 42).

In some embodiments, the mutant polymerases have a backbone sequence of NOZ 77387.1 (e.g., SEQ ID NO:2436) and comprise at least one amino acid substitution mutation that reduces 3' to 5' exonuclease activity compared to a polymerase that lacks an exo-minus mutation. For example, the mutant polymerases comprise at least one amino acid substitution at positions D161 and/or E163. In some embodiments, the mutant polymerases comprise a mutation D161A, D161V, D161L, D161I, D161F, D161Y, D161N, D161T or D161S. In some embodiments, the mutant polymerases comprise a mutation E163A, E163V, E163L, E163I, E163F, E163Y, E163N, E163T or E163S. In some embodiments, the mutant polymerases comprise any combination of mutations at the D161 and the E163 sites.

In some embodiments, the mutant polymerases have a backbone sequence of NOZ 77387.1 (e.g., SEQ ID NO:2436) and comprise at least one amino acid substitution mutations of an LYP motif, for example at positions L448, Y449 and P450. In some embodiments, at least one mutation in the LYP motif can increase the incorporation rate of nucleotide analogs. In some embodiments, any one or any combination of the first, second and/or third positions of the LYP motif can be mutated. For example, mutations of the LYP motif include AAA, SAP, FAG, FGP, YAG, YGP, FAP, YAP, SAG, SGP, LAP, AAG, AGA, AGP, FAA, FGA, SAA, SGA, YGA, AAP, YAA, AGV, AGG, AGI, AAV, AAI, FAI, FTA, FAV, FGG, FGV, LAG, LAI, LGG, LGI, LGV, SAI, SAV, SGG, SGI, YAI, YGG, YGI, LAA, LAV, LGP, LGA, FGI, SGV, YAV, YGV, SYP, LFP, IFP, VFP, LMP, VMP, IMP, LLP, VLP, ILP, LDP, VDP, IDP, LTP, VTP, ITP, LIP, TIP, NNP, NDP, NAP and SYG.

In some embodiments, the polymerases comprise an amino acid of any of SEQ ID NOS:2436-2454 and having an substitution mutation at position L432 comprises a nonpolar amino acid or polar non-charged amino acid. In some embodiments, the amino acid substitution mutation at position L432 comprises valine, glycine, threonine, alanine, serine, isoleucine, leucine, phenylalanine, tyrosine or methionine.

In some embodiments, the polymerases comprise an amino acid of any of SEQ ID NOS:2436-2454 and having an substitution mutation at position Y433 comprises a nonpolar amino acid or a polar uncharged amino acid. In some embodiments, the amino acid substitution mutation at position Y433 comprises threonine, serine, glycine, alanine, valine, isoleucine or tyrosine.

In some embodiments, the polymerases comprise an amino acid of any of SEQ ID NOS:2436-2454 and having an substitution mutation at position P434 comprises a polar uncharged amino acid, non-polar amino acid or a positively charged amino acid. In some embodiments, the amino acid substitution mutation at position P434 comprises serine, glycine, alanine, valine, cysteine, lysine, isoleucine, threonine or proline.

In some embodiments, the polymerases comprise an amino acid of any of SEQ ID NOS:2436-2454 and having an substitution mutation at position Y10. In some embodiments, the amino acid substitution at position Y10 comprises any of the 20 natural amino acids (i.e., W, I, M, P, F, G, A, V, L, H, R, K, D, E, N, C, S, T, or Q) or with non-natural amino acids as are known to those of skill in the art.

In some embodiments, the polymerases comprise an amino acid of any of SEQ ID NOS:2436-2454 and having an substitution mutation at position C41. In some embodiments, the amino acid substitution at position C41 comprises any of the 20 natural amino acids (i.e., W, I, M, P, F, G, A, V, L, H, R, K, D, E, N, Y, S, T, or Q) or with non-natural amino acids as are known to those of skill in the art.

In some embodiments, the polymerases comprise an amino acid of any of SEQ ID NOS:2436-2454 and having an substitution mutation at position C531. In some embodiments, the amino acid substitution at position C531 comprises any of the 20 natural amino acids (i.e., W, I, M, P, F, G, A, V, L, H, R, K, D, E, N, Y, S, T, or Q) or with non-natural amino acids as are known to those of skill in the art.

In some embodiments, the polymerases comprise an amino acid of any of SEQ ID NOS:2436-2454 and having an substitution mutation at position T536. In some embodiments, the amino acid substitution at position T536 comprises any of the 20 natural amino acids (i.e., W, I, M, P, F, G, A, V, L, H, R, K, D, E, N, Y, C, S or Q) or with non-natural amino acids as are known to those of skill in the art.

Engineered Polymerases Comprising Phi29 Backbone Sequence

The present disclosure provides mutant polymerases having a backbone sequence of Phi29. An exemplary wild type Phi29 backbone sequence comprises SEQ ID NO:2455 (e.g., FIG. 28). In some embodiments, the mutant Phi29 polymerases comprise amino acid substitutions at sites that improve binding to nucleotide analogs carrying a chain terminating moiety. For example, mutant Phi29 polymerases can be mutated at sites that are positionally equivalent to the LYP motif in RLF 89458, such as positions L409, Y410 and P411 in RLF 89458 (e.g., see SEQ ID NO:1 and 2). Mutant Phi29 polymerases can be mutated at a site that is positionally equivalent to A485 in RLF 89458 (e.g., see SEQ ID NOS:1 and 2). The amino acid residues that are positionally equivalent in Phi29 and RLF 89458 can be identified by comparing ribbon models which are based on crystal structures of ternary complexes of mutant Phi29 polymerases complexed with a DNA template and primer (e.g., see FIGS. 52-59). Exemplary mutant polymerases include SEQ ID NOS:2456-2501 (see Table 15). In some embodiments, mutant Phi29 polymerases comprise amino acid substitutions at L253 (e.g., any of SEQ ID NOS:2472-2476) which may be positionally equivalent to L409 in RLF 89458. In some embodiments, mutant Phi29 polymerases comprise amino acid substitutions at Y254 (e.g., any of SEQ ID NOS:2477-2479) which may be positionally equivalent to Y410 in RLF 89458. In some embodiments, mutant Phi29 polymerases comprise amino acid substitutions at L381 (e.g., any of SEQ ID NOS:2498-2501) which may be positionally equivalent to A485 in RLF 89458.

In some embodiments, the mutant polymerases having a backbone sequence of Phi29 (e.g., SEQ ID NO:2455, FIG. 28) comprise at least one amino acid substitution mutation that reduces 3' to 5' exonuclease activity compared to a polymerase that lacks an exo-minus mutation. In some embodiments, the mutant polymerases comprise a mutation D12A, D12S, D12N, D12Q or D12K. In some embodiments, the mutant polymerase comprises a mutation E14A. In some embodiments, the mutant polymerases comprise a mutation D66A. In some embodiments, the mutant polymerases comprise a mutation Y165F or Y165C. In some embodiments, the mutant polymerase comprise a mutation D169A. In some embodiments, the mutant polymerases comprise any one or any combination of two or more mutations at the site(s) D12, E14, D66, Y165 and/or D169.

In some embodiments, any of the mutant Phi29 polymerase can bind a nucleotide analog having a nucleo-base that is complementary to a base in the template molecule and catalyze incorporation. Nucleotide analogs comprise chain terminating moieties including 3'-O-azido, 3'-O-methyl-azido, 3'-deoxy nucleotides, 2,3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, 3'-O-benzyl, 3-acetal moiety, or derivatives thereof.

The present disclosure provides one or more mutant polymerases comprising a backbone sequence of Phi29 and having 100%, at least 99%, at least 98%, at least 97%, at least 95%, at least 90% at least 85%, at least 80%, at least 75%, at least 70%, at least 65%, at least 60%, at least 55%, or at least 50% sequence identity to any of SEQ ID NOS: 2455-2501 (Table 15 and FIGS. 28 and 43).

Compositions Comprising Engineered Polymerases

The present disclosure provides polymerases that are mutated at two or more positions to increase thermal stability of the enzyme, exhibit improved binding of nucleotide reagents and/or improved binding and incorporation of nucleotide reagents, improved incorporation rate of nucleotide analogs, improved uracil-tolerance and/or reduced sequence-specific sequencing errors, compared to a wild type polymerase comprising an amino acid sequence of any of SEQ ID NOS: 3-1315, 1317-2214, 2216-2366, 2368-2392, 2394-2407, 2409-2435, 2437-2454, 2456-2501 or 2511-2523. For example, the mutant polymerases exhibit increased thermal stability at a temperature range of about 25-50° C., or about 45-75° C., or about 65-80° C. In another example, the mutant polymerases exhibit increased incorporation rates of nucleotide analogs comprising a chain terminating moiety (e.g., blocking moiety) at the sugar 2' position and/or at the 3' sugar position. The mutant polymerases may exhibit increased uracil tolerance. The mutant polymerases may exhibit improved binding to complementary nucleotide units of a multivalent molecule. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523.

In some embodiments, the mutant polymerases comprise the backbone sequence of RLF 89458.1 or RLF 78286.1 and comprising an amino acid sequence of any of SEQ ID NO:1-1315, and includes amino acid substitutions which can confer exonuclease-minus activity including any of D141A and E143A; D141V and E143A; D141L and E143A; D141I and E143A; D141F and E143A; or D141Y and E143A.

In some embodiments, the mutant polymerases comprise the backbone sequence of NOZ 58130 and comprising an amino acid sequence of any of SEQ ID NO:1316-2214 and includes amino acid substitutions which can confer exonuclease-minus activity including any of D168A and E170A; D168V and E170A; D168L and E170A; D168I and E170A; D168F and E170A; or D168Y and E170A.

In some embodiments, the mutant polymerases comprise the backbone sequence of RMF 90817.1 and comprising an amino acid sequence of any of SEQ ID NO:2215-2366, and includes amino acid substitutions which can confer exonuclease-minus activity including any of D149A and E151A; D149V and E151A; D149L and E151A; D149I and E151A; D149F and E151A; or D149Y and E151A.

In some embodiments, the mutant polymerases comprise the backbone sequence of MBC 7218772.1 and comprising an amino acid sequence of any of SEQ ID NO:2367-2392, and includes amino acid substitutions which can confer exonuclease-minus activity including any of D173A and E175A; D173V and E175A; D173L and E175A; D173I and E175A; D173F and E175A; or D173Y and E175A.

In some embodiments, the mutant polymerases comprise the backbone sequence of WP 175059460.1 and comprising an amino acid sequence of any of SEQ ID NO:2393-2407 and 2511-2523, and includes amino acid substitutions which can confer exonuclease-minus activity including any of D173A and E175A; D173V and E175A; D173L and E175A; D173I and E175A; D173F and E175A; or D173Y and E175A.

In some embodiments, the mutant polymerases comprise the backbone sequence of KUO 42443.1 and comprising an amino acid sequence of any of SEQ ID NO:2408-2435, and includes amino acid substitutions which can confer exonuclease-minus activity including any of D170A and E172A; D170V and E172A; D170L and E172A; D170I and E172A; D170F and E172A; or D170Y and E172A.

In some embodiments, the mutant polymerases comprise the backbone sequence of NOZ 77387.1 and comprising an amino acid sequence of any of SEQ ID NO:2436-2454, and includes amino acid substitutions which can confer exonuclease-minus activity including any of D161A and E163A; D161V and E163A; D161L and E163A; D161I and E163A; D161F and E163A; or D161Y and E163A.

The present disclosure provides engineered archaeal family-B DNA or family-A polymerases, including Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509) and RB69 polymerase (SEQ ID NO:2510), that are mutated in one or more positions that are positionally equivalent (or functionally equivalent sites) to the amino acid substitutions at any one or any combination of positions of a polymerase having a backbone sequence of RLF 89458.1 (SEQ ID NOS:1 or 3-1315) or RLF 78286.1 (SEQ ID NO:2) including D4, D6, Y7, I8, E10, N11, G12, K13, P14, I16, R17, F19, K2O, K21, E22, K23, G24, E25, F26, K27, I28, E29, D31,R32, N33, F34, E35, P36, Y37, I38, Y39, A40, L41, L42, E43, D44, D45, E46, S47, I48, E49, D50, I51, K52, K53, I54, T55, G56, E57, R58, H59, G60, K61, K62, V63, I65, I66, R67, V68, E69, K70, V71, K72, K73, K74, F75, L76, G77, E78, P79, I80, E81, V82, W83, K84, L85, V86, F87, H89, P90, Q91, D92, V93, P94, A95, I96, R97, D98, A99, I100, R101, S102, H103, P104, A105, V106, R107, E108, I109, F110, E111, Y112, D113, I114, P115, F116, A117, K118, R119, Y120, L121, I122, D123, K124, L126, V127, P128, M129, E130, G131, G132, E133, L135, K136, L137, L138, A139, F140, D141, I142, E143, T144, Y146, H147, Y180, A190, K192, R199, Q196, P203, V205, Y209, G211, N213, F214, F216, Y218, I219, C223, E224, G227, L228, F230, T231, I232, G233, R234, S237, E238, P239, K240, Q242, R243, M244, G245, D246, R247, A249, E251, L258, Y261, P262, V264, R265, T267, I268, R269, P271, T272, Y273, T274, L275, E276, A277, V278, V282, F283, K285, K286, K287, E288, K289, V290, A292, I295, E297, A298, K300, S301, L305, R307, V308, Y311, M313, D315, R317, Y320, E321, P328, M329, E332, L333, G338, Q339, D343, S345, S347, S348, G350, N351, L352, V353, W355, Y356, L357, R359, V360, Y362, N365, L367, P372, G373, E376, Q378, M381, Y385, G388, Y389, E394, G396, A402, Y403, L404, F406, R407, S408, L409, Y410, P411, S412, I413, V415, V419, P421, D422, T423, L424, E427, C428, K429, A434, I436, R440, K443, G447, F448, I449, P450, S451, L453, E454, D455, V463, K464, R465, E475, K468, D472, I474, Y481, A485, K487, I488, N491, S492, Y493, Y494, G495, Q497, Y499, S506, K507, E508, C509, E511, S512, V513, T514, G517, R518, H519, I521, T523, E529, K534, V535, E539, D541, I547, P552, S557, K558, A559, K560, K561, H565, E568, K569, G572, M573, E575, E577, L583, G585, F586, V588, T589, K592, I596, H601, T604, G606, V610, R611, R612, D613, E616, I617, K619, E620, T621, Q622, A623, K624, L626, E627, V628, I629, L630, R631, E632, G633, S634, I635, E636, K637, A638, A639, G640, I641, V642, V645, V646, E647, D648, L649, A650, N651, Y652, R653, V654, V656, E657, K658, H662, E663, Q664, I665, T666, R667, E668, K670, D671, Y672, K673, A674, T675, G676, P677, H678, V679, A680, I68I, A682, K683, R684, L685, Q686, A687, R688, G689, I690, K691, V692, K693, P694, T696, I698, S699, V702, L703, K704, G705, S706, K707, K708, I709, D711, R712, V713, I714, L715, F716, D717, E718, D720, S721, S722, R723, K725, Y726, P728, Y730, Y731, I732, H733, N734, Q735, V736, P738, A739, V740, L741, R742, I743, L744, E745, A746, F747, G748, Y749, K750, E751, K752, D753, L754, E755, Y756, Q757, R758, M759, K760, Q761, T762, G763, L764, G765, A766, W767, L768 and/or M770. From the sequence alignment shown in FIG. 45, the skilled artisan can ascertain positionally equivalent positions (or functionally equivalent sites) in Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), Pfu polymerase (SEQ ID NO:2508) and/or *Pyrococcus abyssi* polymerase (SEQ ID NO:2509).

The present disclosure provides engineered archaeal family-B DNA or family-A polymerases, including Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509) and RB69 polymerase (SEQ ID NO:2510), that are mutated in one or more positions that are positionally equivalent (or functionally equivalent sites) to the amino acid substitutions at any one or any combination of positions of a polymerase having a backbone sequence of NOZ 58130.1 (SEQ ID NO:1316-2214) including Y14, E18, F26, G29, F34, V35, V36, F41, S42, P43, F45, P49, R55, L61, A62, S63, A65, E67, I69, K71, V72, E76, K77, T82, P83, R84, V85, T90, V91, S92, H93, P94, Q95, D96, V97, P98, R99, I100, R101, E102, R103, R105, D111, I113, E115, H116, D117, I118, V121, R122, R123, I126, P132, L133, W135, R150, E153, E157, E158, R163, V164, A165, D168, I169, E170, V171, L253, G275, A276, L277, V288, L290, Y291, P292, V298, L313, K319, D321, F326, T327, D330, E331, L338, A352, C362, A376, M378, V384, L387, T393, E407, Y408, A409, R413, R422, V434, D436, F437, 5439, L440, Y441, P442, 5443, 1444, 1445, V446, T454, A465, F479, 1480, R496, F511, A515, 5522, F523, Y524, M527, R537, E538, C539, E541, V543, A544, A547, M549, 1551, M555, E559, E565, V566, D570, D572, 1578, L585, A586, Q587, E595, V615, T616, R619, K628, K650, I655, A665, E674, R675, R677, D685, T690, S698, S701, E703, V707, E718, M723, K734, G735, S737, Q738, D752, D758, N759, R767, 1772, Y774, L779, K780, E781, G782, 1783, T784, Q785, T786, S787, L788, S789, R790, W791 and/or F792. From the sequence alignment shown in FIG. 46, the skilled artisan can ascertain positionally equivalent positions (or functionally equivalent sites) in Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), Pfu polymerase (SEQ ID NO:2508) and/or *Pyrococcus abyssi* polymerase (SEQ ID NO:2509).

The present disclosure provides engineered archaeal family-B DNA or family-A polymerases, including Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509) and RB69 polymerase (SEQ ID NO:2510), that are mutated in one or more positions that are positionally equivalent (or functionally equivalent sites) to the amino acid substitutions at any one or any combination of positions of a polymerase having a backbone sequence of RMF 90817.1 (SEQ ID NO:2215-2366) including Y11, D15, F23, K25, 128, L29, F34, Q35, P36, F38, H43, E49, G55, A56, V57, R62, R67, 175, L76, S77, H78, P79, S80, E81, V82, P83, K84, I85, R86, E87, E88, R90, E96, 198, E100, H101, D102, I103, A106, R108, I111, P117, L118, E138, G139, R144, V145, M146, D149, 1150, E151, T152, A234, Y272, C307, R312, E333, A357, V365, L368, F374, L390, V415, D417, F418, 5420, L421, Y422, P423, 1425, V427, T435, P445, F459, A496, 5503, F504, Y505, M508, K518, E519, C520, 5523, V524, T525, M530, T532, D551, D553, V559, R566, A567, M568, R576, I596, T597, N609, Q631, V636, A646, N655, R656, K658, D666, T671, R679, N682, K688, E699, M704, G715, L716, N740, L753, Y755, K761, E762, E763, M764, V765, Q766, G767, 5768, L769, Q770, R771, W772 and/or F773. From the sequence alignment shown in FIG. 47, the skilled artisan can ascertain positionally equivalent positions (or functionally equivalent sites) in Geobacillus stearothermophilus (e.g., Bst DNA polymerase) (SEQ ID NOS:2503 or 2504) (including THERMINATOR polymerase; SEQ ID NO:2505), Pfu polymerase (SEQ ID NO:2508) and/or *Pyrococcus abyssi* polymerase (SEQ ID NO:2509).

The present disclosure provides engineered archaeal family-B DNA or family-A polymerases, including Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509) and RB69 polymerase (SEQ ID NO:2510), that are mutated in one or more positions that are positionally equivalent (or functionally equivalent sites) to the amino acid substitutions at any one or any combination of positions of a polymerase having a backbone sequence of MBC 7218772.1 (SEQ ID NO:2367-2392) including I10, C468 and/or T560. From the sequence alignment shown in FIG. 48, the skilled artisan can ascertain positionally equivalent positions (or functionally equivalent sites) in Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), Pfu polymerase (SEQ ID NO:2508) and/or *Pyrococcus abyssi* polymerase (SEQ ID NO:2509).

The present disclosure provides engineered archaeal family-B DNA or family-A polymerases, including Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509) and RB69 polymerase (SEQ ID NO:2510), that are mutated in one or more positions that are positionally equivalent (or functionally equivalent sites) to the amino acid substitutions at any one or any combination of positions of a polymerase having a backbone sequence of WP 175059460.1 (SEQ ID NO:2393-2407 and 2511-2523) including Y7, D11, I51, K61, V93, A117, M129, D141, I142, E143, T144, A223, E302, E323, D407, F408, S410, L411, Y412, P413, R487, A488, 5495, Y496, K510, T517, 1524, K562, A563, R564, S572, T593, R605, K652, D675, K695, T700, R712, R759, Y760, Q761, 5762, 5763, K764, Q765 and/or T766. From the sequence alignment shown in FIG. 49, the skilled artisan can ascertain positionally equivalent positions (or functionally equivalent sites) in Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), Pfu polymerase (SEQ ID NO:2508) and/or *Pyrococcus abyssi* polymerase (SEQ ID NO:2509).

The present disclosure provides engineered archaeal family-B DNA or family-A polymerases, including Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509) and RB69 polymerase (SEQ ID NO:2510), that are mutated in one or more positions that are positionally equivalent (or functionally equivalent sites) to the amino acid substitutions at any one or any combination of positions of a polymerase having a backbone sequence of KUO 42443.1 (SEQ ID NO:2408-2435) including Y7, D170, E172, T557 and/or 5558. From the sequence alignment shown in FIG. 50, the skilled artisan can ascertain positionally equivalent positions (or functionally equivalent sites) in Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), Pfu polymerase (SEQ ID NO:2508) and/or *Pyrococcus abyssi* polymerase (SEQ ID NO:2509).

The present disclosure provides engineered archaeal family-B DNA or family-A polymerases, including Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509) and RB69 polymerase (SEQ ID NO:2510), that are mutated in one or more positions that are positionally equivalent (or functionally equivalent sites) to the amino acid substitutions at any one or any combination of positions of a polymerase having a backbone sequence of NOZ 77387.1 (SEQ ID NO:2436-2454) including Y10, C41, C531 and/or T536. From the sequence alignment shown in FIG. 51, the skilled artisan can ascertain positionally equivalent positions (or functionally equivalent sites) in Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), Pfu polymerase (SEQ ID NO:2508) and/or *Pyrococcus abyssi* polymerase (SEQ ID NO:2509).

The present disclosure provides polymerases operably linked to a detectable reporter moiety. Any of the polymerases described herein can be labeled with a detectable reporter moiety, including polymerases having a mutant amino acid sequence backbone of any polymerase described herein, including any of SEQ ID NOS: 3-1315, 1317-2214, 2216-2366, 2368-2392, 2394-2407, 2409-2435, 2437-2454, 2456-2501 or 2511-2523, Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509), RB69 polymerase (SEQ ID NO:2510) and Phi29 (SEQ ID NO:2455).

In some embodiments, the detectable reporter moiety generates a detectable signal resulting from a chemical or physical change (e.g., heat, light, electrical, pH, salt concentration, enzymatic activity, or proximity events such as FRET). In some embodiments, the detectable reporter moiety comprises a luminescent moiety, fluorescent moiety, or quencher. In some embodiment, the detectable moiety comprises a fluorescent moiety that behaves as a FRET donor or acceptor. The detectable reporter moiety can be attached to the polymerase at the N-terminus, C-terminus or any internal location. The detectable reporter moiety is attached to the polymerase in a manner that does not interfere with the ability of the polymerase to bind a nucleic acid template molecule, a nucleic acid primer, or a nucleotide. The detectable reporter moiety is attached to the polymerase in a manner that does not interfere with catalytic activity of the polymerase including nucleotide incorporation.

The present disclosure provides recombinant fusion polypeptides which include any of the DNA polymerases described herein operably linked to any one or any combination of two or more exogenous amino acid sequences for affinity purification, cleavage or solubilization. In some embodiments, the recombinant fusion polypeptides comprise polymerases having a mutant amino acid sequence backbone of any polymerase described herein, including any of SEQ ID NOS: 3-1315, 1317-2214, 2216-2366, 2368-2392, 2394-2407, 2409-2435, 2437-2454, 2456-2501 or 2511-2523, Geobacillus stearothermophilus (e.g., Bst DNA polymerase) (SEQ ID NO:2502), 9° N polymerase (SEQ ID NOS:2503 or 2504) (including THERMINATOR polymerase; SEQ ID NO:2505), VENT polymerase (SEQ ID NO:2506), DEEP VENT polymerase (SEQ ID NO:2507), Pfu polymerase (SEQ ID NO:2508) and/or *Pyrococcus abyssi* polymerase (SEQ ID NO:2509), RB69 polymerase (SEQ ID NO:2510) and Phi29 (SEQ ID NO:2455).

In some embodiments, the recombinant fusion polypeptides comprise any of the wild type and mutant polymerases described herein operably linked at their N- and/or C-terminus end(s) to at least one affinity purification tag sequence, where the affinity purification tag sequence(s) include a Histidine tag (e.g., hexa-histidine tag), FLAG tag, T7 tag, Strep II tag, S tag (e.g., from pancreatic ribonuclease A), HA tag (e.g., from human influenza hemagglutinin protein) and/or c-Myc tag.

In some embodiments, the recombinant fusion polypeptides comprise any of the wild type and mutant polymerases described herein operably linked at their N- and/or C-terminus end(s) to at least one polypeptide cleavage sequence, or the polypeptide cleavage sequence can be positioned between an affinity tag sequence and the N-terminus or C-terminus end of the polymerase sequence. In some embodiments, the polypeptide cleavage sequence can be recognized and cleaved with a protease or a reducing condition. In some embodiments, the polypeptide cleavage sequence comprises a thrombin cleavage sequence, TEV cleavage sequence (e.g., from tobacco etch virus including AcTEV and ProTEV), factor Xa cleavage sequence, enterokinase cleavage sequence, and SUMO cleavage sequence (e.g., Small ubiquitin-like modified including Ulp1, Senp2 and SUMOstar).

In some embodiments, the recombinant fusion polypeptides comprise any of the wild type and mutant polymerases described herein operably linked at their N- and/or C-terminus end(s) to at least one exogenous amino acid sequence for improving solubilization, including maltose binding protein (MBP), small ubiquitin-like modifier (SUMO) and glutathione S-transferase (GST).

The present disclosure provides a composition comprising: one or more mutant polymerases and at least one nucleic acid template molecule and at least one nucleic acid primer. In some embodiments, the one or more mutant polymerases may, or may not, be bound to the at least one nucleic acid template molecule and at least one nucleic acid primer. In some embodiments, the primer provides an initiation site for nucleotide polymerization. In some embodiments, the primer comprises a 3' extendible end for a polymerase-catalyzed nucleotide incorporation reaction, or the primer comprises a 3' non-extendible end. In some embodiments, the nucleic acid template molecule includes at least one uridine nucleotide or lacks a uridine nucleotide. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases include amino acid substitutions that confer exonuclease-minus activity. In some embodiments, the polymerases comprise at least one mutation that increases thermal stability of the enzyme, improves binding of nucleotide reagents and/or improved binding and incorporation of nucleotide reagent, improves incorporation rate of nucleotide analogs, improves uracil-tolerance and/or reduced sequence-specific sequencing errors, compared to their corresponding wild type polymerase.

The present disclosure provides a composition comprising: one or more mutant polymerases and at least one nucleic acid template molecule having a self-priming 3' end. In some embodiments, the one or more mutant polymerases may, or may not, be bound to the at least one nucleic acid template molecule having a self-priming 3' end. In some embodiments, the self-priming 3' end of the template molecule provides an initiation site for nucleotide polymerization. In some embodiments, the nucleic acid template molecule includes at least one uridine nucleotide or lacks a uridine nucleotide. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases include amino acid substitutions that confer exonuclease-minus activity. In some embodiments, the polymerases comprise at least one mutation that increases thermal stability of the enzyme, improves incorporation rate of nucleotide analogs and/or improves uracil-tolerance compared to their corresponding wild type polymerase.

In some embodiments, the composition comprises: one or more mutant polymerases bound to nucleic acid duplexes each comprising a nucleic acid template hybridized to a nucleic acid primer, thereby forming a complexed polymerase. In some embodiments, the primer provides an initiation site for nucleotide polymerization. In some embodiments, the mutant polymerase is bound to a nucleic acid template molecule having a self-priming 3' end to form a complexed polymerase that lacks a separate primer molecule. In some embodiments, the nucleic acid template molecule includes at least one uridine nucleotide or lacks a uridine nucleotide. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases are recombinant polymerases.

In some embodiments, the composition comprises one or more mutant polymerases, at least one nucleic acid template molecule, and an initiation site for nucleotide polymerization, wherein the mutant polymerases are in solution, the nucleic acid template molecules are in solution, and the initiation sites (e.g., primers) are in solution. In some embodiments, the composition comprises one or more mutant polymerases, at least one nucleic acid template molecule, and an initiation site for nucleotide polymerization, wherein the composition comprises any combination of mutant polymerases that are in solution, the nucleic acid template molecules that are in solution or immobilized to a support, and the initiation sites (e.g., primers) that are in solution or immobilized to a support. In some embodiments, the composition comprises one or more mutant polymerases, at least one nucleic acid template molecule, and an initiation site for nucleotide polymerization, wherein the composition comprises any combination of mutant polymerases that are in solution or immobilized to a support, the nucleic acid template molecules that are in solution or immobilized to a support, and the initiation sites (e.g., primers) that are in solution or immobilized to a support.

In some embodiments, the mutant polymerases exhibit increased thermal stability compared to the wild type polymerase having the amino acid sequence of any of SEQ ID NOS: 1, 2, 1316, 2215, 2367, 2393, 2408 or 2436. For example, the mutant polymerases exhibit increased thermal stability at a temperature range of about 25-50° C. or about 45-80° C.

In some embodiments, the mutant polymerases exhibit increased incorporation rate of nucleotide analogs compared to a wild type polymerase comprising any of SEQ ID NOS: 1, 2, 1316, 2215, 2367, 2393, 2408 or 2436, where the nucleotide analogs comprise a chain terminating moiety (e.g., blocking moiety) at the sugar 2' position and/or at the 3' sugar position.

In some embodiments, the mutant polymerases exhibit increased uracil-tolerance compared to a wild type polymerase comprising any of SEQ ID NOS: 1, 2, 1316, 2215, 2367, 2393, 2408 or 2436.

In some embodiments, the mutant polymerases exhibit increased ability to bind complementary nucleotide units of a multivalent molecule compared to a wild type polymerase comprising any of SEQ ID NOS: 1, 2, 1316, 2215, 2367, 2393, 2408 or 2436.

In some embodiments, the composition comprises: one or more mutant polymerases, and a plurality of nucleic acid duplexes each comprising a nucleic acid template hybridized to a nucleic acid primer. In some embodiments, the one or more polymerases and the nucleic acid duplex further comprises nucleotide reagents. The one or more mutant polymerases may or may not be bound to the nucleic acid duplex. The one or more mutant polymerases may or may not be bound to the nucleotide reagents. In some embodiments, the one or mutant polymerases is bound to the nucleic acid duplex comprising a nucleic acid template hybridized to a nucleic acid primer, thereby forming a complexed polymerase. In some embodiments the complexed polymerase further comprises a nucleotide reagent. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases are recombinant polymerases.

In some embodiments, nucleotide reagents comprise any one or any combination of nucleotides and/or multivalent molecules. In some embodiments, the nucleotides comprise canonical nucleotides. In some embodiments, the nucleotides comprise detectably labeled nucleotides each comprising a detectable reporter moiety joined to a nucleo-base or one of the phosphate moieties of the phosphate chain. In some embodiments, the nucleotides comprise nucleotides carrying a removable or non-removable chain terminating moiety. In some embodiments, the reversible chain terminating nucleotides can detectably labeled or non-labeled. In some embodiments, individual multivalent molecules comprise a central core attached to multiple polymer arms each having a nucleotide unit at the end of the arms.

In some embodiments, the complexed polymerase further comprises a nucleotide reagent which comprises a nucleotide. In some embodiments, the nucleotide can bind to a complexed polymerase without incorporation. In some embodiments, a complementary nucleotide can bind a complexed polymerase without undergoing polymerase-catalyzed incorporation to form a ternary complex in which the complementary nucleotide binds the 3' end of the primer at a position that is opposite a complementary nucleotide in the template strand.

In some embodiments, at least one nucleotide in the plurality of nucleotides comprise a base, sugar and at least one phosphate group. In some embodiments, at least one nucleotide in the plurality comprises an aromatic base, a five carbon sugar (e.g., ribose or deoxyribose), and one or more phosphate groups (e.g., 1-10 phosphate groups). The plurality of nucleotides can comprise at least one type of nucleotide selected from a group consisting of dATP, dGTP, dCTP, dTTP and dUTP. The plurality of nucleotides can comprise at a mixture of any combination of two or more types of nucleotides selected from a group consisting of dATP, dGTP, dCTP, dTTP and/or dUTP.

In some embodiments, at least one nucleotide in the plurality of nucleotides comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including O, S or $BH_3$. In some embodiments, the chain includes phosphate groups substituted with analogs including phosphoramidate, phosphorothioate, phosphordithioate, and O-methylphosphoroamidite groups.

In some embodiments, at least one nucleotide in the plurality of nucleotides comprises a nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, silyl group or acetal group. In some embodiments, the chain terminating moiety is cleavable/removable from the nucleotide, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) ($Pd(PPh_3)_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate ($K_2CO_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride. In some embodiments, the chain terminating moiety may be cleavable/removable with nitrous acid. In some embodiments, a chain terminating moiety may be cleavable/removable using a solution comprising nitrite, such as, for example, a combination of nitrite with an acid such as acetic acid, sulfuric acid, or nitric acid. In some further embodiments, said solution may comprise an organic acid.

In some embodiments, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP). In some embodiments, the chain terminating moiety comprising one or more of a 3'-O-amino group, a 3'-O-aminomethyl group, a 3'-O-methylamino group, or derivatives thereof may be cleaved with nitrous acid, through a mechanism utilizing nitrous acid, or using a solution comprising nitrous acid. In some embodiments, the chain terminating moiety comprising one or more of a 3'-O-amino group, a 3'-O-aminomethyl group, a 3'-O-methylamino group, or derivatives thereof may be cleaved using a solution comprising nitrite. In some embodiments, for example, nitrite may be combined with or contacted with an acid such as acetic acid, sulfuric acid, or nitric acid. In some further embodiments, for example, nitrite may be combined with or contacted with an organic acid such as for example, formic acid, acetic acid, propionic acid, butyric acid, isobutyric acid, or the like. In some embodiments, the chain terminating moiety comprises a 3'-acetal moiety which can be cleaved with a palladium deblocking reagent (e.g., Pd(0)).

In some embodiments, the nucleotide analog comprise a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3' butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof.

In some embodiments, the plurality of nucleotides comprises a plurality of nucleotides that lack a detectable reporter moiety, for example a fluorophore. In some embodiments, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base.

In some embodiments, the cleavable linker on the base comprises a cleavable moiety comprising an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the cleavable linker on the base is cleavable/removable from the base by reacting the cleavable moiety with a chemical agent, pH change, light or heat. In some embodiments, the cleavable moieties alkyl, alkenyl, alkynyl and allyl are cleavable with tetrakis(triphenylphosphine) palladium(0) ($Pd(PPh_3)_4$) with piperidine, or with 2,3-Dichloro-5,6-dicyano-1,4-benzo-quinone (DDQ). In some embodiments, the cleavable moieties aryl and benzyl are cleavable with H2 Pd/C. In some embodiments, the cleavable moieties amine, amide, keto, isocyanate, phosphate, thio, disulfide are cleavable with phosphine or with a thiol group including beta-mercaptoethanol or dithiothritol (DTT). In some embodiments, the cleavable moiety carbonate is cleavable with potassium carbonate ($K_2CO_3$) in MeOH, with triethylamine in pyridine, or with Zn in acetic acid (AcOH). In some embodiments, the cleavable moieties urea and silyl are cleavable with tetrabutylammonium fluoride, pyridine-HF, with ammonium fluoride, or with triethylamine trihydrofluoride.

In some embodiments, the cleavable linker on the base comprises cleavable moiety including an azide, azido or azidomethyl group. In some embodiments, the cleavable moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxypropyl)phosphine (THPP). In some embodiments, the cleaving agent comprises 4-dimethylaminopyridine (4-DMAP).

In some embodiments, the chain terminating moiety (e.g., at the sugar 2' and/or sugar 3' position) and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

In some embodiments, the composition comprises: one or more mutant polymerases and a plurality of nucleic acid duplexes each comprising a nucleic acid template hybridized to a nucleic acid primer. In some embodiments, the one or more polymerases and the nucleic acid duplex further comprises a plurality of nucleotide reagents. In some embodiments, the one or more polymerases and the nucleic acid duplex further comprises a plurality of multivalent molecules. The one or more mutant polymerases may or may not be bound to the nucleic acid duplex. The one or more mutant polymerases may or may not be bound to one or more of the multivalent molecules. In some embodiments, the one or mutant polymerases is bound to the nucleic acid duplex comprising a nucleic acid template hybridized to a nucleic acid primer, thereby forming a complexed polymerase. In some embodiments, the complexed polymerase further comprises at least one nucleotide reagent (e.g., plurality of multivalent molecules). In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases are recombinant polymerases.

In some embodiments, nucleotide reagents comprise any one or any combination of nucleotides and/or multivalent molecules. In some embodiments, the nucleotides comprise canonical nucleotides. In some embodiments, the nucleotides comprise nucleotide analogs comprise detectably labeled nucleotides and/or nucleotides carrying a removable or non-removable chain terminating moiety. In some embodiments, individual multivalent molecules comprise a central core attached to multiple polymer arms each having a nucleotide unit at the end of the arms.

In some embodiments, the multivalent molecule generally comprises a central moiety (e.g., a core) attached to a plurality of arms where each arm is attached to a nucleotide unit. The multivalent molecule comprises a star, comb, cross-linked, bottle brush, or dendrimer configuration. In some embodiments, the multivalent molecule may comprise 2-4, 4-10, 10-20, or up to 64 arms. In some embodiments, the arms may radiate from a central moiety.

Figure 4:
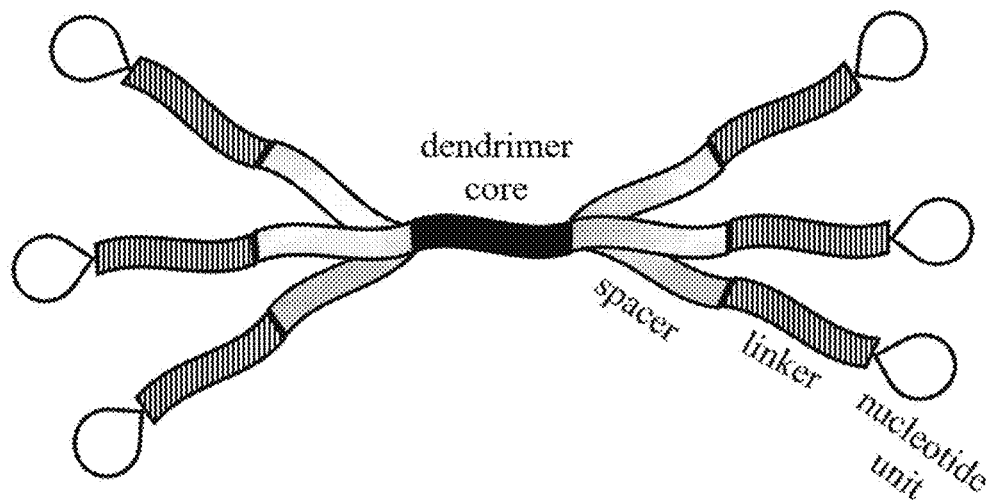
FIG. 4 is a schematic of an exemplary multivalent molecule comprising a dendrimer core attached to a plurality of nucleotide-arms.
Figure 5:
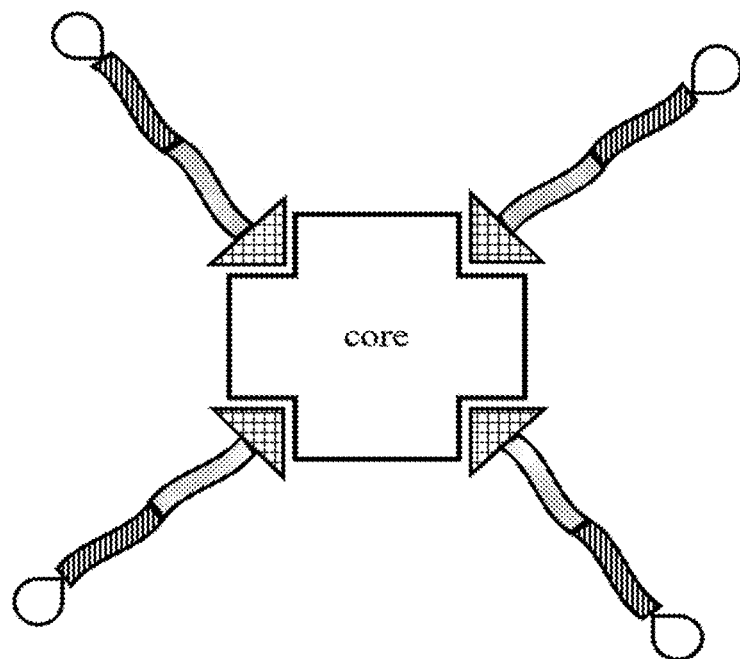
FIG. 5 shows a schematic of an exemplary multivalent molecule comprising a core attached to a plurality of nucleotide-arms, where the nucleotide arms comprise biotin, spacer, linker and a nucleotide unit.
Figure 6:
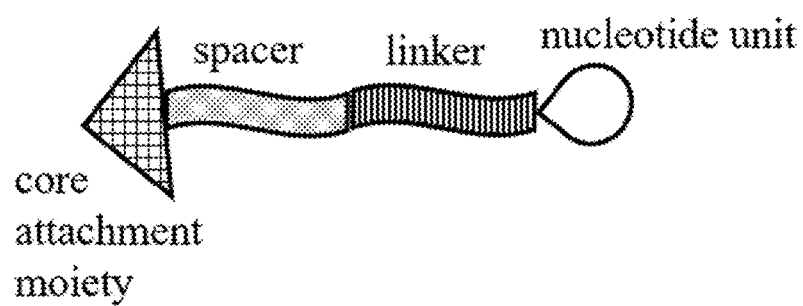
FIG. 6 is a schematic of an exemplary nucleotide-arm comprising a core attachment moiety, spacer, linker and nucleotide unit.
Figure 10:
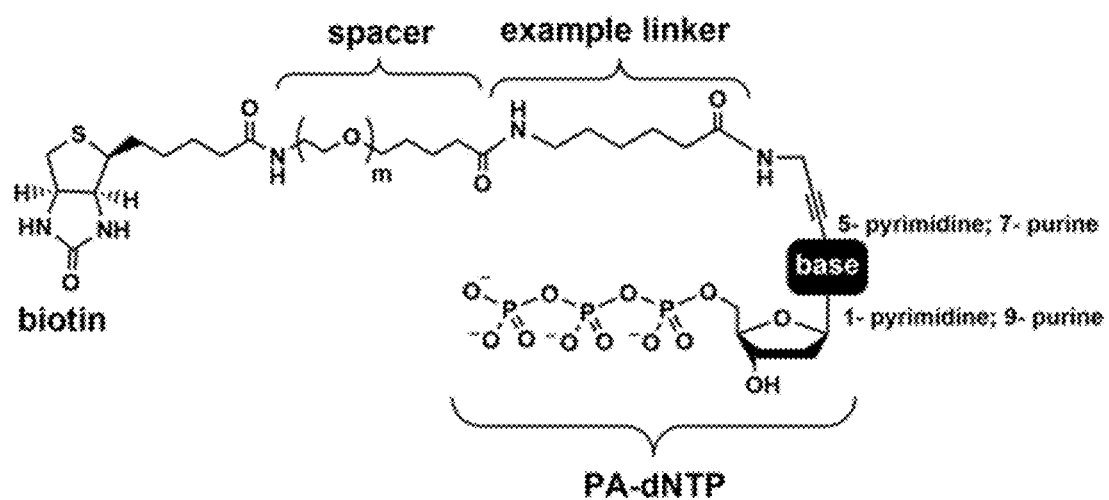
FIG. 10 shows the chemical structure of an exemplary biotinylated nucleotide-arm. In this example, the nucleotide unit is connected to the linker via a propargyl amine attachment at the 5 position of a pyrimidine base or the 7 position of a purine base.
Figure 52:
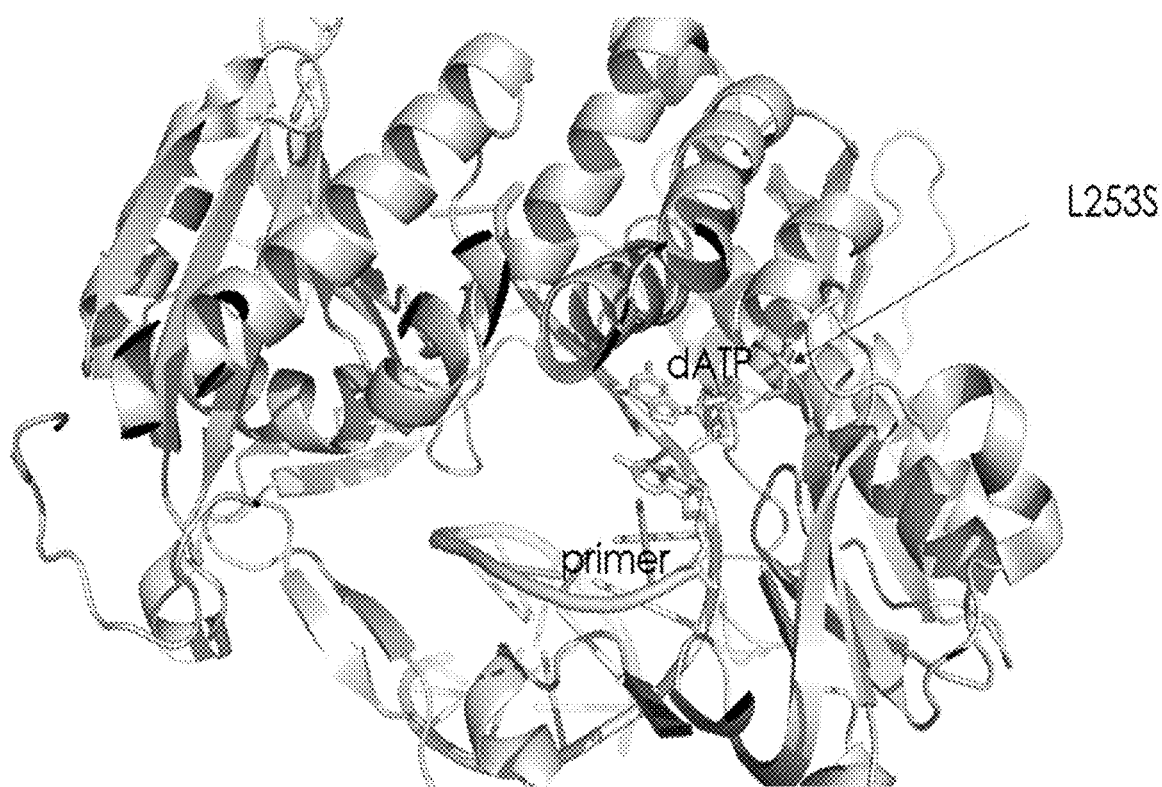
FIG. 52 is a ribbon model based on a crystal structure of a ternary complex of a Phi29 DNA polymerase comprising an amino acid substitution mutation L253S.
Figure 53:
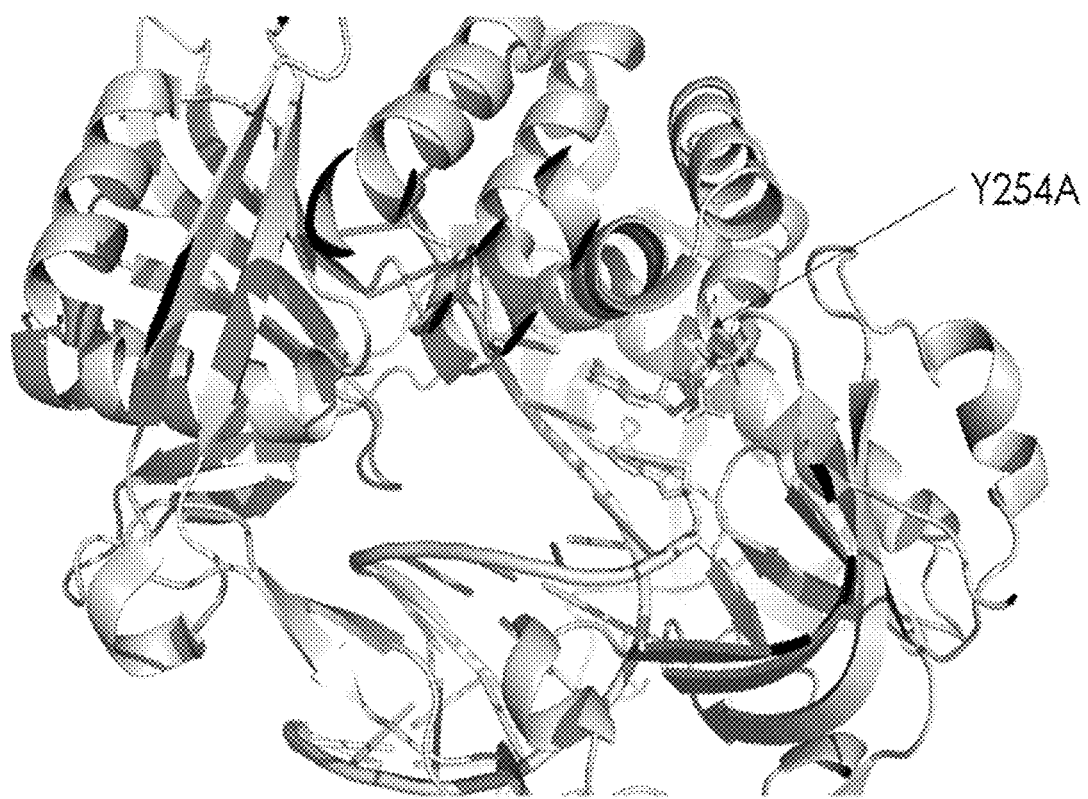
FIG. 53 is a ribbon model based on a crystal structure of a ternary complex of a Phi29 DNA polymerase comprising an amino acid substitution mutation Y254A.
Figure 54:
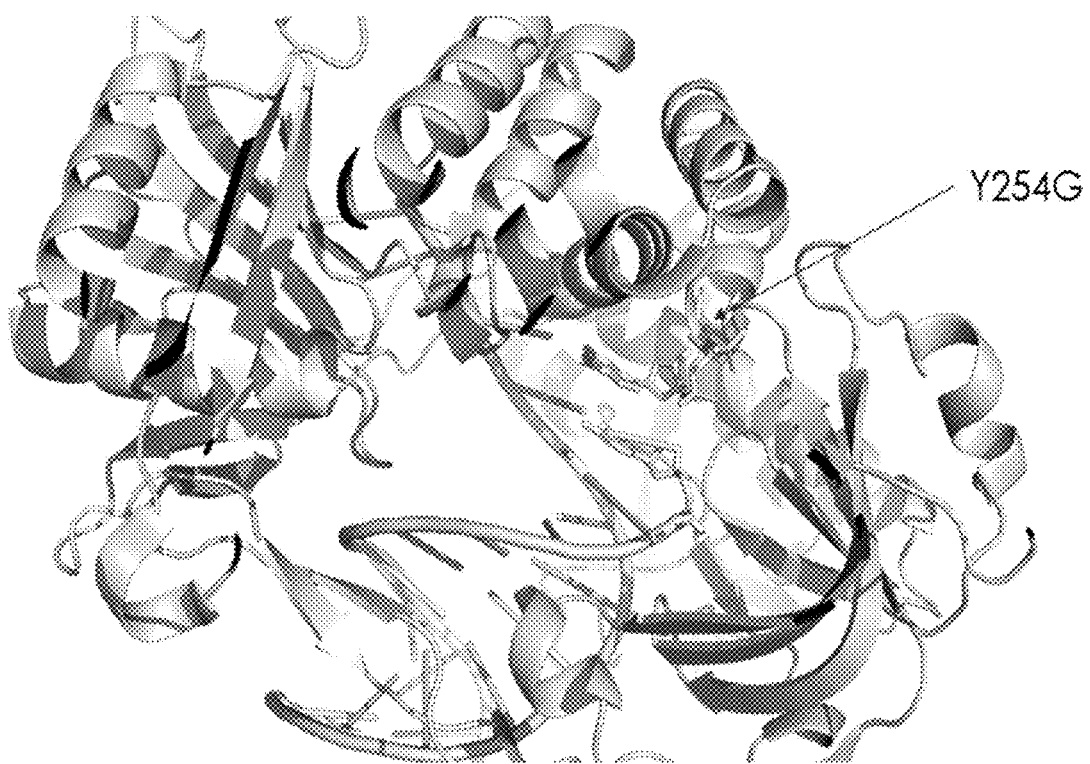
FIG. 54 is a ribbon model based on a crystal structure of a ternary complex of a Phi29 DNA polymerase comprising an amino acid substitution mutation Y254G.
Figure 55:
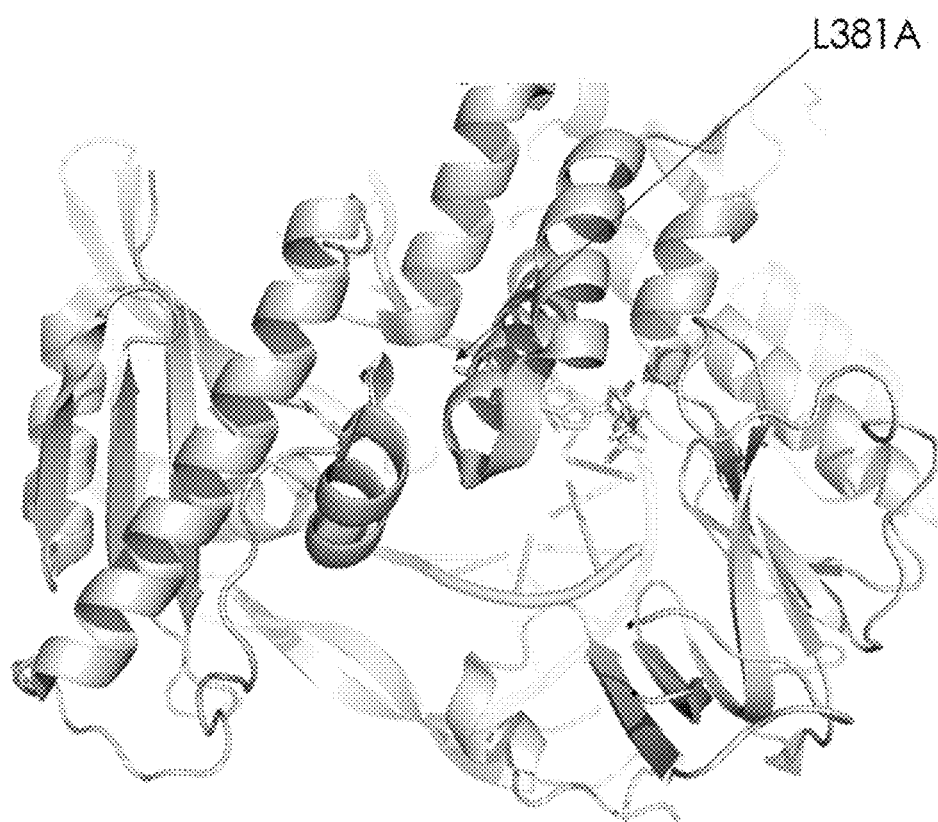
FIG. 55 is a ribbon model based on a crystal structure of a ternary complex of a Phi29 DNA polymerase comprising an amino acid substitution mutation L381A.
Figure 56:
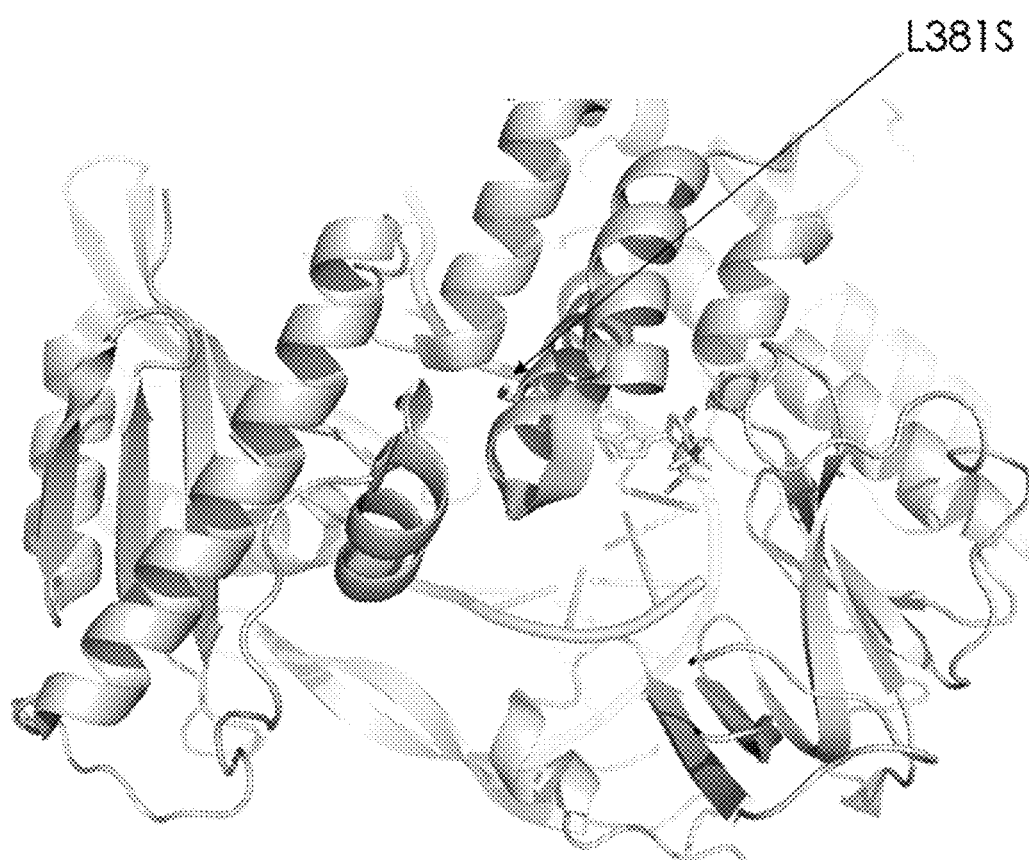
FIG. 56 is a ribbon model based on a crystal structure of a ternary complex of a Phi29 DNA polymerase comprising an amino acid substitution mutation L381S.
Figure 57:
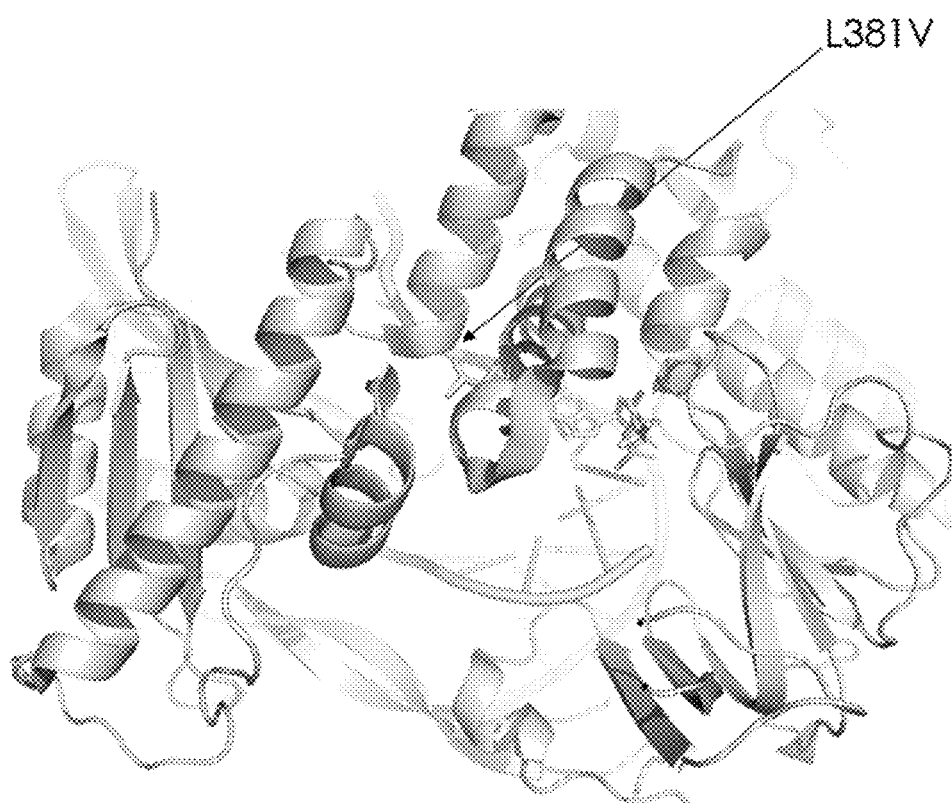
FIG. 57 is a ribbon model based on a crystal structure of a ternary complex of a Phi29 DNA polymerase comprising an amino acid substitution mutation L381V.
Figure 58:
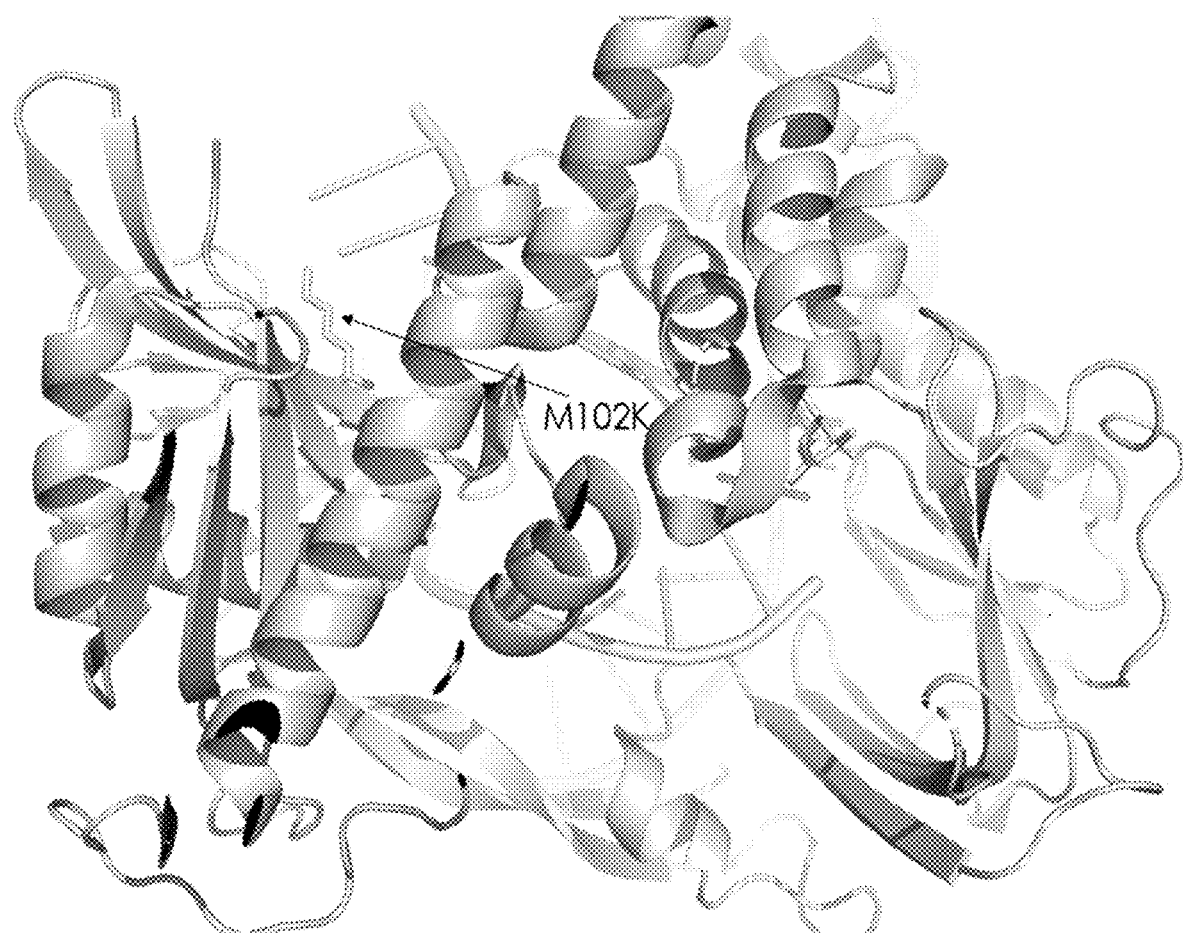
FIG. 58 is a ribbon model based on a crystal structure of a ternary complex of a Phi29 DNA polymerase comprising an amino acid substitution mutation M102K.
Figure 59:
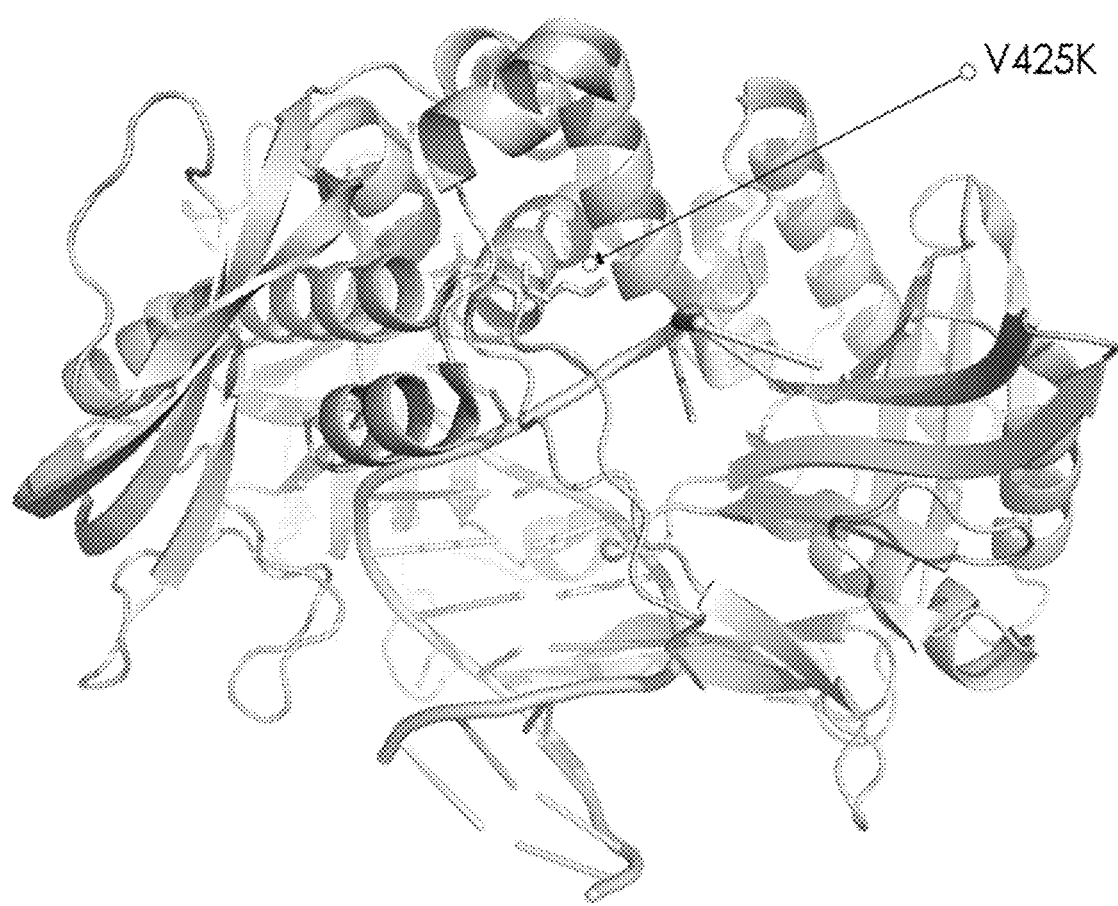
FIG. 59 is a ribbon model based on a crystal structure of a ternary complex of a Phi29 DNA polymerase comprising an amino acid substitution mutation V425K.

In some embodiments, at least one multivalent molecule in the plurality of multivalent molecules comprises: (a) a core; and (b) a plurality of nucleotide arms which comprise (i) a core attachment moiety, (ii) a spacer (e.g., comprising a PEG moiety), (iii) a linker, and (iv) a nucleotide unit, wherein the core is attached to the plurality of nucleotide arms, wherein the spacer is attached to the linker, wherein the linker is attached to the nucleotide unit. In some embodiments, the nucleotide unit comprises a base, sugar and at least one phosphate group, and the linker is attached to the nucleotide unit through the base. In some embodiments, the linker comprises an aliphatic chain or an oligo ethylene glycol chain where both linker chains having 2-6 subunits. In some embodiments, the linker also includes an aromatic moiety. Exemplary multivalent molecules are shown in FIGS. 2-5. An exemplary nucleotide arm is shown in FIG. 6. An exemplary spacer is shown in FIG. 7 (top). Various exemplary linkers are shown in FIG. 7 (bottom) and FIG. 8. Examples of various linkers joined/attached to nucleotide units are shown in FIGS. 9A-D, where the 5 position of a pyrimidine base or the 7 position of a purine base is attached to the linker via a propargyl amine attachment (see also FIG. 10).

In some embodiments, the nucleotide-arm is designed so that the nucleotide unit of the nucleotide-arm is capable of interacting with a polymerase enzyme in a manner similar to a free nucleotide. The nucleotide unit of a nucleotide-arm can bind a polymerase which is complexed with a nucleic acid template and nucleic acid primer (e.g., nucleotide association). The nucleotide unit can also dissociate from the complexed polymerase and either re-bind the same complexed polymerase or bind a different complexed polymerase that is proximal to the multivalent molecule. Since a multivalent molecule comprises multiple nucleotide-arms, the nucleotide units of a single multivalent molecule can bind multiple complexed polymerases at the same time. The multivalent molecules effectively increase the local concentration of nucleotides which can enhance signals in a nucleotide binding reaction.

In some embodiments, a nucleotide unit of the multivalent molecule can bind to a complexed polymerase without incorporation. In some embodiments, a complementary nucleotide unit of a multivalent molecule can bind a complexed polymerase without undergoing polymerase-catalyzed incorporation in which the complementary nucleotide unit binds the 3' end of the primer at a position that is opposite a complementary nucleotide in the template strand.

In some embodiments, a nucleotide unit of the multivalent molecule can bind to a complexed polymerase, and undergo primer extension by incorporating into the 3' end of an extendible primer (e.g., complexed with the polymerase) resulting in primer extension. When the nucleotide unit includes a sugar 3'OH then a subsequent nucleotide can be incorporated into the nascent extended primer. When the nucleotide unit includes a sugar 3'OH substituted with a blocking group, then a subsequent nucleotide is blocked from being incorporated into the nascent extended primer strand. A nucleotide unit (of a multivalent molecule) can bind the 3' end of the primer at a position that is opposite a complementary nucleotide in the template strand. The nucleotide unit can undergo nucleotide incorporation in a polymerase-catalyzed reaction, thereby extending the primer by one nucleotide.

In some embodiments, the core, linker and/or nucleotide unit of the multivalent molecule can be labeled with a detectable reporter moiety (e.g., fluorophore) in a manner that permits distinction between different multivalent molecules carrying a different type of nucleotide unit. For example, the core unit of a first multivalent molecule is labeled with a first fluorophore, where the first multivalent molecule comprises multiple nucleotide-arms with dGTP nucleotide units. The core unit of a second multivalent molecule is labeled with a second fluorophore (which differs from the first fluorophore), where the second multivalent molecule comprises multiple nucleotide-arms with dATP nucleotide units. The binding and incorporating events of the nucleotide unit can be detected, and the specific base of the nucleotide unit (as part of the multivalent molecule) can be identified based on detection and identification of the detectable reporter moiety on the core. In another example, the linker and/or nucleotide unit of a first multivalent molecule is labeled with a first fluorophore, where the first multivalent molecule comprises multiple nucleotide-arms with dGTP nucleotide units. The linker and/or nucleotide unit of a second multivalent molecule is labeled with a second fluorophore (which differs from the first fluorophore), where the second multivalent molecule comprises multiple nucleotide-arms with dATP nucleotide units. The binding and incorporating events of the nucleotide unit can be detected, and the specific base of the nucleotide unit (as part of the multivalent molecule) can be identified based on detection and identification of the detectable reporter moiety on the core. In some embodiments, the core, linker and nucleotide unit are not labeled with a detectable reporter moiety.

In some embodiments, at least one nucleotide unit attached to the nucleotide arm of the multivalent molecule can be labeled with a detectable reporter moiety (e.g., fluorophore) in a manner that permits distinction between different multivalent molecules carrying a different type of nucleotide unit. For example, the nucleotide unit of a first multivalent molecule is labeled with a first fluorophore, where the first multivalent molecule comprises multiple nucleotide-arms with dGTP nucleotide units. The nucleotide unit of a second multivalent molecule is labeled with a second fluorophore (which differs from the first fluorophore), where the second multivalent molecule comprises multiple nucleotide-arms with dATP nucleotide units. The binding and incorporating events of the nucleotide unit can be detected, and the specific base of the nucleotide unit (as part of the multivalent molecule) can be identified based on detection and identification of the detectable reporter moiety on the nucleotide unit.

In some embodiments, individual multivalent molecules in the plurality of multivalent molecules comprise a core attached to multiple nucleotide arms, and wherein the multiple nucleotide arms have the same type of nucleotide unit which is selected from a group consisting of dATP, dGTP, dCTP, dTTP and dUTP.

In some embodiments, the nucleotide unit of the at least one multivalent molecule comprises an aromatic base, a five carbon sugar (e.g., ribose or deoxyribose), and one or more phosphate groups (e.g., 1-10 phosphate groups). The plurality of multivalent molecules can comprise one type multivalent molecule having one type of nucleotide unit selected from a group consisting of dATP, dGTP, dCTP, dTTP and dUTP. The plurality of nucleotides can comprise at a mixture of any combination of two or more types of multivalent molecules, where individual multivalent molecules in the mixture comprise nucleotide units selected from a group consisting of dATP, dGTP, dCTP, dTTP and/or dUTP.

Figure 61:
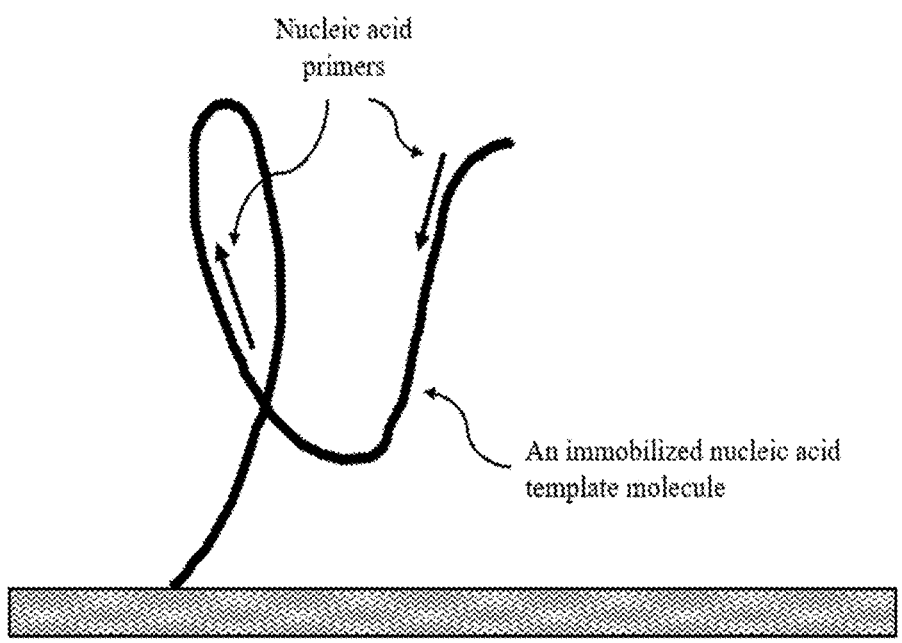
FIG. 61 is a schematic of an exemplary immobilized nucleic acid template molecule hybridized to a first and a second nucleic acid primer. The nucleic acid template molecule shown in FIG. 61 comprises a concatemer which is hybridized with a plurality of nucleic acid primers.
Figure 62:
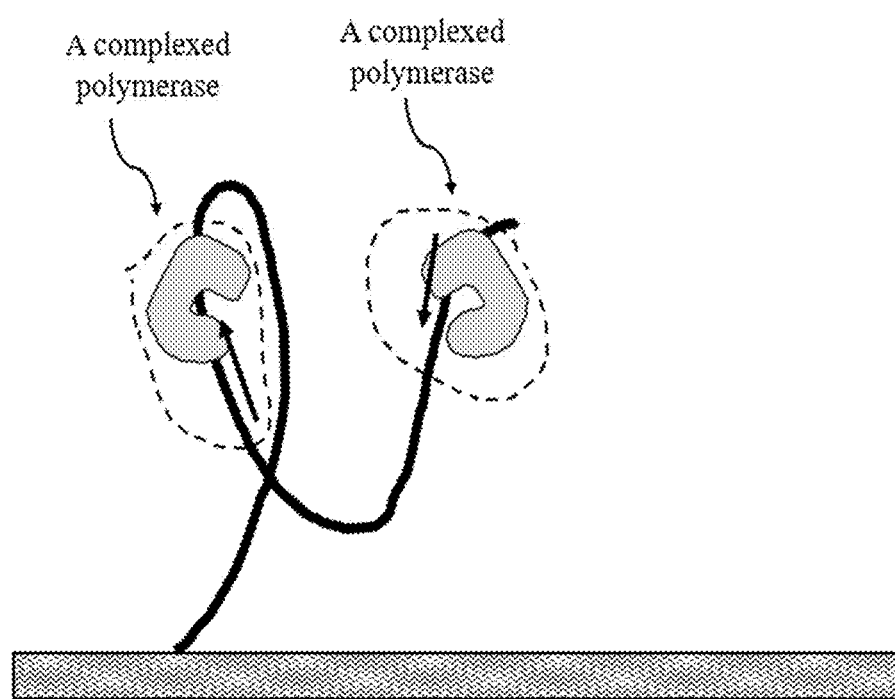
FIG. 62 is a schematic of exemplary complexed polymerases indicated by the dashed circles, where individual complexed polymerases comprise a DNA polymerase bound to nucleic acid duplex, where each duplex comprises a nucleic acid template hybridized to a nucleic acid primer.
Figure 63:
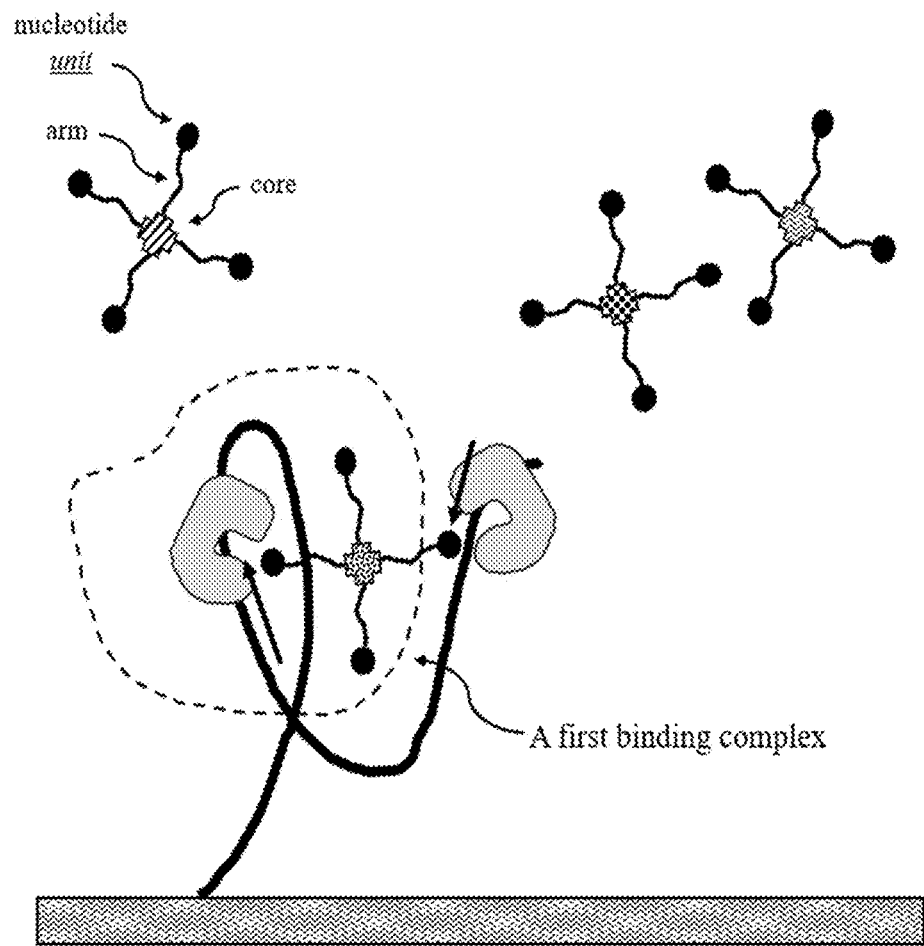
FIG. 63 is a schematic of an exemplary first binding complex (e.g., indicated by a dashed circle) comprising a first nucleic acid primer, a first DNA polymerase, and a first multivalent molecule bound to a first portion of a concatemer template molecule thereby forming a first binding complex.
Figure 64:
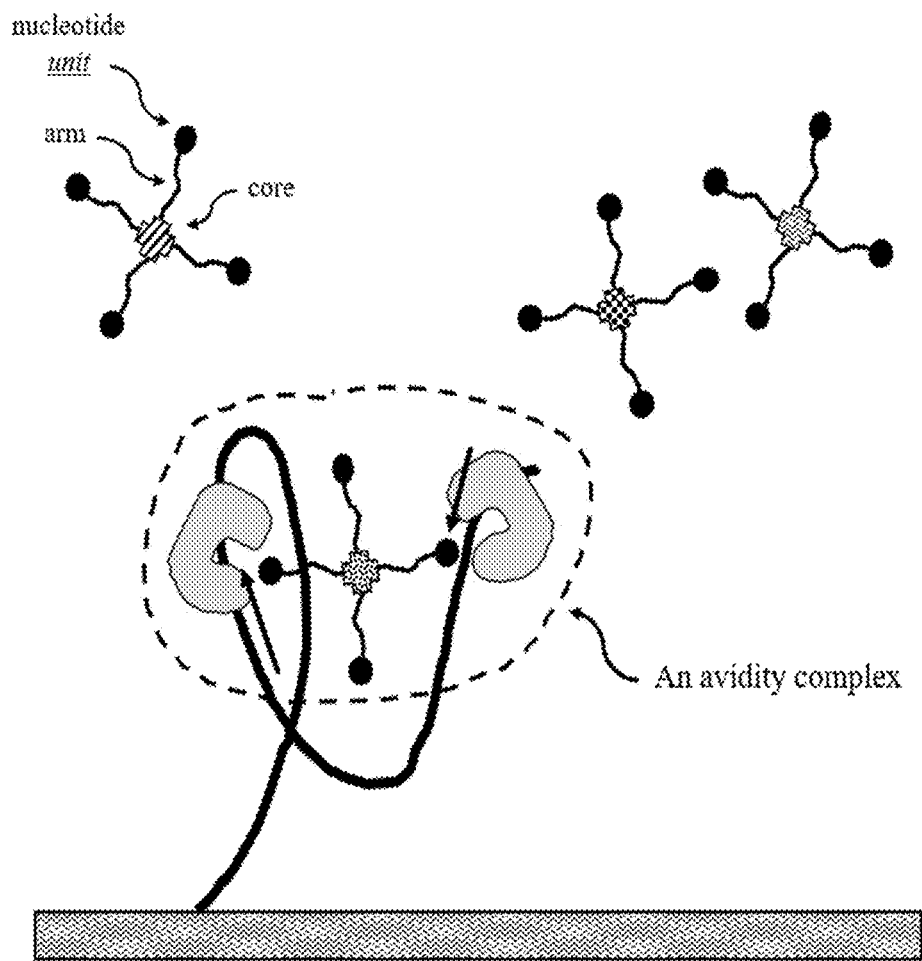
FIG. 64 is a schematic of an exemplary avidity complex (e.g., indicated by a dashed circle) comprising (i) a first binding complex which comprises a first nucleic acid primer, a first DNA polymerase, and a first multivalent molecule bound to a first portion of a concatemer template molecule thereby forming a first binding complex, wherein a first nucleotide unit of the multivalent molecule is bound to the first DNA polymerase, and (ii) the second binding complex which comprises a second nucleic acid primer, a second DNA polymerase, and the same first multivalent molecule bound to a second portion of the same concatemer template molecule thereby forming a second binding complex, wherein a second nucleotide unit of the multivalent molecule is bound to the second DNA polymerase, and wherein the first and second binding complexes which include the same multivalent molecule forms an avidity complex.

In some embodiments, the plurality of complexed mutant DNA polymerases further comprise a first and second binding complex and a multivalent molecule which forms an avidity complex, wherein (i) the first binding complex comprises a first nucleic acid primer, a first DNA polymerase, and a first multivalent molecule bound to a first portion of a concatemer template molecule thereby forming a first binding complex (e.g., FIGS. 61-63), wherein a first nucleotide unit of the multivalent molecule is bound to the first DNA polymerase, and (ii) the second binding complex comprises a second nucleic acid primer, a second DNA polymerase, and the first multivalent molecule bound to a second portion of the same concatemer template molecule thereby forming a second binding complex (e.g., FIGS. 61-63), wherein a second nucleotide unit of the multivalent molecule is bound to the second DNA polymerase, wherein the first and second binding complexes which include the same multivalent molecule forms an avidity complex (e.g., FIG. 64). In some embodiments, the first polymerase comprises any mutant polymerase described herein. In some embodiments, the second polymerase comprises any mutant polymerase described herein. The concatemer template molecule comprises tandem repeat sequences of a sequence of interest and at least one universal sequencing primer binding site. The first and second nucleic acid primers can bind to a sequencing primer binding site along the concatemer template molecule.

In some embodiments, in the system, the plurality of complexed DNA polymerases further comprise a first and second binding complex and a multivalent molecule which forms an avidity complex, wherein (i) the first binding complex comprises a first nucleic acid primer, a first DNA polymerase, and a first multivalent molecule bound to a first template molecule thereby forming a first binding complex, wherein a first nucleotide unit of the multivalent molecule is bound to the first DNA polymerase, and (ii) the second binding complex comprises a second nucleic acid primer, a second DNA polymerase, and the first multivalent molecule bound to a second template molecule thereby forming a second binding complex, wherein a second nucleotide unit of the multivalent molecule is bound to the second DNA polymerase, wherein the first and second binding complexes which include the same multivalent molecule forms an avidity complex. In some embodiments, the first polymerase comprises any mutant polymerase described herein. In some embodiments, the second polymerase comprises any mutant polymerase described herein. In some embodiments, the first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second nucleic acid primers can bind to a sequencing primer binding site on the first and second template molecules, respectively.

In some embodiments, at least one multivalent molecule in the plurality of multivalent molecules comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups (e.g., 1-10 phosphate groups) substituted with analogs including phosphoramidate, phosphorothioate, phosphordithioate, and O-methylphosphoroamidite groups.

In some embodiments, individual multivalent molecules in the plurality of multivalent molecule comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, at least one multivalent molecule in the plurality of multivalent molecules comprises a nucleotide unit comprising a nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the chain terminating moiety is cleavable/removable from the nucleotide, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) (Pd(PPh$_3$)$_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate (K$_2$CO$_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride.

In some embodiments, at least one multivalent molecule in the plurality of multivalent molecules comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, at least one multivalent molecule in the plurality of multivalent molecules comprises a nucleotide unit comprising a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof.

In some embodiments, at least one multivalent molecule in the plurality of multivalent molecules comprises a core attached to multiple nucleotide arms, wherein the core is labeled with detectable reporter moiety. In some embodiments, the detectable reporter moiety comprises a fluorophore.

In some embodiments, at least one multivalent molecule in the plurality of multivalent molecules comprises a nucleotide unit attached to multiple nucleotide arms, wherein the nucleotide unit is labeled with detectable reporter moiety. In some embodiments, the detectable reporter moiety comprises a fluorophore.

In some embodiments, at least one multivalent molecule in the plurality of multivalent molecules comprises at least one linker that is part of a nucleotide arm, wherein the linker is labeled with detectable reporter moiety. In some embodiments, the detectable reporter moiety comprises a fluorophore.

Figure 2:
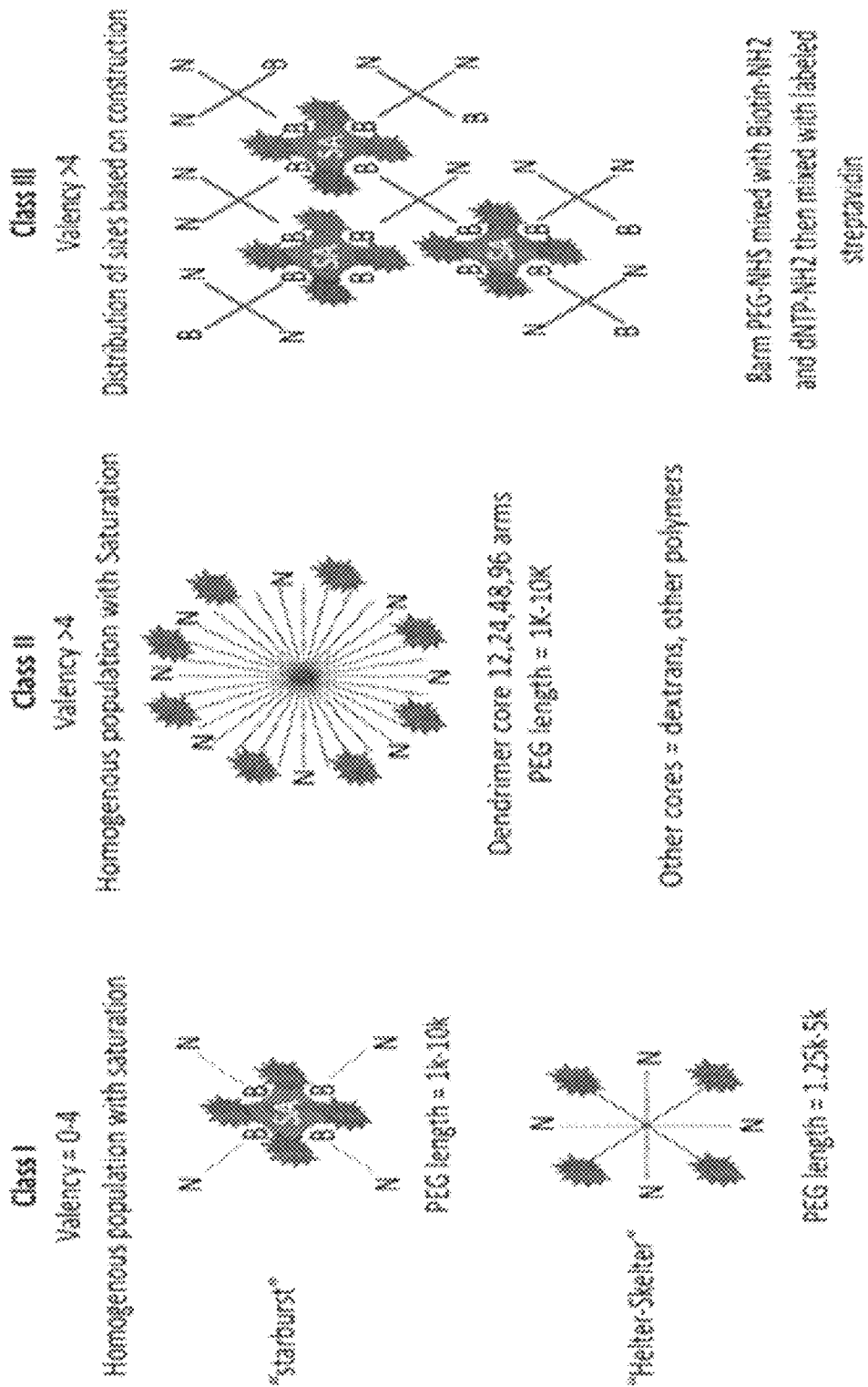
FIG. 2 is a schematic of various exemplary configurations of multivalent molecules. Left (Class I): schematics of multivalent molecules having a "starburst" or "helter-skelter" configuration. Center (Class II): a schematic of a multivalent molecule having a dendrimer configuration. Right (Class III): a schematic of multiple multivalent molecules formed by reacting streptavidin with 4-arm or 8-arm PEG-NETS with biotin and dNTPs. Nucleotide units are designated 'N', biotin is designated B', and streptavidin is designated 'SA'.
Figure 3:
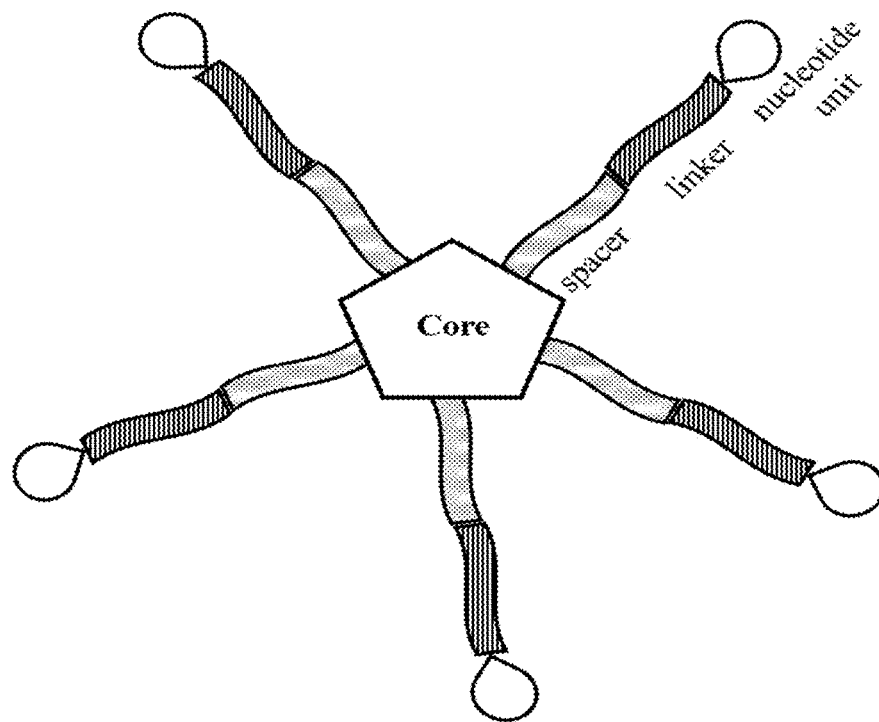
FIG. 3 is a schematic of an exemplary multivalent molecule comprising a generic core attached to a plurality of nucleotide-arms.

In some embodiments, the core comprises an streptavidin-type or avidin-type moiety and the core attachment moiety comprises biotin. In some embodiments, the core comprises an streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™. Exemplary multivalent molecules are shown in FIGS. 2-3 and 5 in which a generic core is conjugated to a plurality of nucleotide-arms. An exemplary multivalent molecule is shown in FIG. 4 in which a generic dendrimer core is conjugated to a plurality of nucleotide-arms. An exemplary design for a multivalent molecule is shown in FIG. 5, which shows a core (e.g., streptavidin core) attached/bound to a plurality of nucleotide-arms, where the nucleotide arms comprise a core attachment moiety (e.g., biotin), spacer, linker and nucleotide unit. An exemplary biotinylated nucleotide-arm comprising biotin, spacer, linker and nucleotide unit, is shown in FIG. 6.

In some embodiments, the composition comprises: one or more mutant polymerases which are bound to nucleic acid duplexes each comprising a nucleic acid template hybridized to a nucleic acid primer, thereby forming a complexed polymerase, and the composition further comprises at least one cation. In some embodiment, the at least one cation is selected from the group consisting of strontium, barium, sodium, magnesium, potassium, manganese, calcium, lithium, nickel and cobalt. In some embodiments, the cation comprises a catalytic divalent cation that promotes polymerase-catalyzed nucleotide incorporation, wherein the catalytic divalent cations comprise magnesium or manganese. In some embodiments, the cation comprises a non-catalytic divalent cation that inhibits polymerase-catalyzed nucleotide incorporation, wherein the non-catalytic divalent cations comprise strontium, barium and/or calcium.

In some embodiments, the composition comprises: one or more mutant polymerases which are bound to nucleic acid duplexes each comprising a nucleic acid template molecule hybridized to a nucleic acid primer, thereby forming a complexed polymerase. In some embodiments, the nucleic acid template molecule comprises a linear nucleic acid molecule, or a circular nucleic acid molecule, or a mixture of both linear and circular nucleic acid molecules. In some embodiments, the nucleic acid template molecules in the plurality of nucleic acid template molecules comprise the same target sequence of interest or different target sequences of interest. In some embodiments, the nucleic acid template molecule comprises an amplified nucleic acid molecule. In some embodiments, the nucleic acid template molecule comprises a clonally-amplified template molecule or a single nucleic acid template molecule. In some embodiments, the nucleic acid template molecule comprises one copy of a target sequence of interest. In some embodiments, the nucleic acid template molecule comprises two or more tandem copies of a target sequence of interest (e.g., a concatemer). In some embodiments, the nucleic acid template molecules includes at least one uridine nucleotide or lacks a uridine nucleotide. In some embodiments, the primer provides an initiation site for nucleotide polymerization. In some embodiments, the nucleic acid primer comprises an extendible 3' terminal end or a non-extendible 3' terminal end. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523.

In some embodiments, the complexed polymerase is immobilized to a support, where any of the nucleic acid template, nucleic acid primer and/or polymerase is/are immobilized to the support. In some embodiments, the composition comprises a plurality of complexed polymerases immobilized to a support. In some embodiments, about $10^2$-$10^{15}$ complexed polymerases are immobilized to a support at different sites on the support. In some embodiments, the plurality of complexed polymerases are immobilized to pre-determined sites (e.g., locations) on the support. In some embodiments, the plurality of complexed polymerases are immobilized to random sites (e.g., locations) on the support. In some embodiments, the plurality of immobilized complexed mutant DNA polymerases are in fluid communication with each other to permit flowing a solution of reagents (e.g., enzymes including polymerases, multivalent molecules, nucleotides and/or divalent cations, and the like) onto the support so that the plurality of immobilized complexed polymerases on the support can be reacted with the solution of reagents in a massively parallel manner.

In some embodiments, the support comprises a planar or non-planar support. The support can be solid or semi-solid. In some embodiments, the support can be porous, semi-porous or non-porous. In some embodiments, the surface of the support can be coated with one or more compounds to produce a passivated layer on the support. In some embodiments, the passivated layer forms a porous or semi-porous layer. In some embodiments, the nucleic acid primer or template, or the polymerase, can be attached to the passivated layer to immobilize the primer, template and/or polymerase to the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that can be used for immobilizing a plurality of nucleic acid template molecules to the support. In some embodiments, the support can comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacet-amidylpentyl)acrylamide-co-acrylamide (PAZAM). In some embodiments, the support comprises a surface coating having at least one hydrophilic polymer coating layer and at least one layer of a plurality of oligonucleotides. The hydrophilic polymer coating layer can comprise polyethylene glycol (PEG). The hydrophilic polymer coating layer can comprise branched PEG having at least 4 branches. In some embodiments, the low non-specific binding coating has a degree of hydrophilicity which can be measured as a water contact angle, where the water contact angle is no more than 45 degrees.

In some embodiments, the composition comprises a plurality of complexed polymerases, having at least a first and second complexed polymerase, wherein: (a) the first complexed polymerases comprises a first mutant polymerase bound to a first nucleic acid duplex comprising a first nucleic acid template molecule which is hybridized to a first nucleic acid primer, (b) the second complexed polymerases comprises a second mutant polymerase bound to a second nucleic acid duplex comprising a second nucleic acid template molecule which is hybridized to a second nucleic acid primer. In some embodiments, the first and second nucleic acid template molecule comprise the same or different sequences. In some embodiments, the first and second nucleic acid template molecules are clonally-amplified. In some embodiments, the first and/or the second nucleic acid template molecule includes at least one uridine nucleotide or lacks a uridine nucleotide. In some embodiments, the first and second primers comprise extendible 3' ends or non-extendible 3' ends. In some embodiments, the first and second mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the first and second mutant polymerases are recombinant polymerases.

In some embodiments, the plurality of complexed polymerases (including the first and second complexed polymerases) are immobilized to a support. In some embodiments, the density of the plurality of complexed polymerases comprises about $10^2$-$10^{15}$ per mm$^2$ complexed polymerases that are immobilized to the support. In some embodiments, the first and second nucleic acid template molecules are immobilized to a different site on the support. In some embodiments, the support comprises a plurality of sites arranged in an array. In some embodiments, the sites on the support are arranged in one dimension in a row or a column, or arranged in two dimensions in rows and columns. In some embodiments, the plurality of sites is arranged on the support in a random or organized fashion, or a combination of both. In some embodiments, the plurality of sites is arranged in any pattern, including rectilinear or hexagonal patterns. In some embodiments, the support comprises about $10^2$-$10^{15}$ sites per mm$^2$ or more that are immobilized with nucleic acid templates to form a nucleic acid template array. In some embodiments, the nucleic acid templates that are immobilized at a plurality of sites, for example the nucleic acid template molecules are immobilized at about $10^2$-$10^{15}$ sites per mm$^2$ or more, where the immobilized nucleic acid templates are clonally-amplified to generate immobilized nucleic acid polonies at the plurality of sites. In some embodiment, the plurality of nucleic acid template molecules immobilized on the support are in fluid communication with each other to permit flowing a solution of a reagents (e.g., a plurality of enzymes (e.g., polymerases), a plurality of nucleotides and/or a plurality of multivalent molecules) onto the support so that the plurality of nucleic acid template molecules immobilized on the support can be reacted with the plurality of reagents in a massively parallel manner. In some embodiments, the fluid communication of the plurality of nucleic acid polonies immobilized on the support can be used to conduct nucleotide binding assays and/or conduct nucleotide incorporation assays (e.g., primer extension or sequencing) essentially simultaneously on the plurality of nucleic acid polonies. In some embodiments, the fluid communication of the plurality of nucleic acid polonies immobilized on the support can be used to conduct detection and imaging for massively parallel sequencing. In some embodiments, the term "immobilized" and related terms refer to nucleic acid molecules or enzymes that are attached directly to a support through covalent bond or non-covalent interaction, or attached to a coating on the support. In some embodiments, the low non-specific binding coating has a degree of hydrophilicity which can be measured as a water contact angle, where the water contact angle is no more than 45 degrees.

In some embodiments, a binding complex comprises a mutant polymerase, a nucleic acid template molecule duplexed with a primer, and a nucleotide reagent. In some embodiments, a binding complex comprises (i) a mutant polymerase, a nucleic acid template molecule duplexed with a primer, and a nucleotide, or the binding complex comprises (ii) a mutant polymerase, a nucleic acid template molecule duplexed with a primer, and a nucleotide unit of a multivalent molecule. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the binding complex has a persistence time of greater than about 0.1, 0.2, 0.3, 0.4, 0.5, 0.6, 0.7, 0.8, 0.9, 1 or 30 seconds or more than 30 seconds. The binding complex has a persistence time of greater than about 0.1-0.25 seconds, or about 0.25-0.5 seconds, or about 0.5-0.75 seconds, or about 0.75-1 second, or about 1-2 seconds, or about 2-3 seconds, or about 3-4 second, or about 4-5 seconds, or about 5-30 seconds, or more than 30 seconds and/or wherein the method is or may be carried out at a temperature of at or above 15° C., at or above 20° C., at or above 25° C., at or above 35° C., at or above 37° C., at or above 42° C. at or above 55° C. at or above 60° C., or at or above 72° C., or at or above 80° C., or within a range defined by any of the foregoing. In some embodiments, the binding complexes may have a persistence time of less than 1s, greater than 1s, greater than 2s, greater than 3s, greater than 5s, greater than 10s, greater than 15s, greater than 20s, greater than 30s, greater than 60s, greater than 120s, greater than 360s, greater than 3600s, or more, or for a time lying within a range defined by any two or more of these values. The binding complex (e.g., ternary complex) remains stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water. In some embodiments, the present disclosure provides said method wherein the binding complex is deposited on, attached to, or hybridized to, a surface showing a contrast to noise ratio in the detecting step of greater than 20. In some embodiments, the present disclosure provides said method wherein the contacting is performed under a condition that stabilizes the binding complex when the nucleotide or nucleotide unit is complementary to a next base of the template nucleic acid, and destabilizes the binding complex when the nucleotide or nucleotide unit is not complementary to the next base of the template nucleic acid.

The present disclosure provides a composition comprising a reaction mixture which comprises: (a) one or more mutant polymerases; (b) a nucleic acid template molecule; (c) a nucleic acid primer having a 3' extendible end or a 3' non-extendible end; and (d) a plurality of nucleotides or a plurality of multivalent molecules. In some embodiments, the one or more mutant polymerases are not bound to the nucleic acid template molecules. In some embodiments, the one or more mutant polymerases are not bound to the nucleic acid primers. In some embodiments, the one or more mutant polymerases are bound to nucleic acid duplexes comprising a nucleic acid template hybridized to a nucleic acid primer, thereby forming complexed polymerases. In some embodiments, the nucleic acid template molecules includes at least one uridine nucleotide or lacks a uridine nucleotide. In some embodiments, the plurality of nucleotides includes at least one uridine nucleotide or lacks a uridine nucleotide. In some embodiments, the mutant polymerases comprise an amino acid sequence that is at least 80%, 85%, 90%, 95%, 99% identical, or a higher level sequence identity, to any of SEQ ID NOS:1-2501.

In some embodiments, the reaction mixture further comprises (e1) at least one non-catalytic divalent cation that permits binding at least one nucleotide to the complexed polymerase or that permits binding at least one multivalent molecule to the complexed polymerase, but the non-catalytic divalent cation inhibits polymerase-catalyzed incorporation. In some embodiments the non-catalytic divalent cation comprises strontium, barium and/or calcium.

In some embodiments, the reaction mixture further comprises (e2) at least one catalytic divalent cation that permits binding at least one nucleotide to the complexed polymerase or that permits binding at least one multivalent molecule to the complexed polymerase, and the catalytic divalent cation promotes polymerase-catalyzed incorporation. In some embodiments, the catalytic divalent cation comprises magnesium and/or manganese. In some embodiments, the nucleic acid template and nucleic acid primer are in solution. In some embodiments, the nucleic acid template and/or the nucleic acid primer is immobilized to a support or immobilized to a coating on a support.

In some embodiments, the reaction mixture is suitable for use in conducting a nucleotide binding reaction (or multivalent molecule binding reaction). In some embodiments, the reaction mixture is suitable for use in conducting a nucleotide incorporation reaction (or incorporation reaction of the nucleotide unit of the multivalent molecule). In some embodiments, the reaction mixture is suitable for use in conducting a primer extension reaction in which the nucleotide incorporates into the 3' end of the extendible primer (or the nucleotide unit of the multivalent molecule incorporates into the 3' end of the extendible primer).

Kits

The present disclosure provides a kit comprising at least one mutant polymerase comprising an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523.

In some embodiments, the kit further comprises at least one cation. In some embodiment, the at least one cation is selected from the group consisting of strontium, barium, sodium, magnesium, potassium, manganese, calcium, lithium, nickel and cobalt.

In some embodiments, the kit further comprises a plurality of nucleic acid primers having an extendible 3' terminal end or a non-extendible 3' terminal end. In some embodiments, at least one of the primers can be immobilized to a support. In some embodiments, the immobilized primers (e.g., capture primers) can be used to hybridize to nucleic acid templates. In some embodiments, at least one of the primers comprise a sequencing primer that can hybridize to an adaptor sequence (e.g., universal adaptor sequence) appended to a template molecule.

In some embodiments, the kit further comprises a plurality of nucleotides. In some embodiments, at least one nucleotide in the plurality of nucleotides comprise a base, sugar and at least one phosphate group. In some embodiments, at least one nucleotide in the plurality comprises an aromatic base, a five carbon sugar (e.g., ribose or deoxyribose), and one or more phosphate groups (e.g., 1-10 phosphate groups). The plurality of nucleotides can comprise at least one type of nucleotide selected from a group consisting of dATP, dGTP, dCTP, dTTP and dUTP. The plurality of nucleotides can comprise at a mixture of any combination of two or more types of nucleotides selected from a group consisting of dATP, dGTP, dCTP, dTTP and/or dUTP.

In some embodiments, in the kit, at least one nucleotide in the plurality of nucleotides comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups substituted with analogs including phosphoramidate, phosphorothioate, phosphordithioate, and O-methylphosphoroamidite groups.

In some embodiments, in the kit, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the kit can also include a chemical agent that cleaves the chain terminating moieties. For example, the kit comprises any one or any combination of tetrakis(triphenylphosphine)palladium(0) $(Pd(PPh_3)_4)$ with piperidine, or with 2,3-Dichloro-5,6-dicyano-1,4-benzo-quinone (DDQ), H2 Pd/C, or a phosphine or with a thiol group including beta-mercaptoethanol or dithiothritol (DTT). In some embodiments, the kit includes a chemical agent comprising potassium carbonate ($K_2CO_3$) in MeOH, with triethylamine in pyridine, or with Zn in acetic acid (AcOH). In some embodiments, the kit includes a chemical agent comprising tetrabutylammonium fluoride, pyridine-HF, with ammonium fluoride, or with triethylamine trihydrofluoride. In some embodiments, the kit includes a chemical agent comprising nitrous acid. In some embodiments, the kit includes a solution comprising nitrite, such as, for example, a combination of nitrite with an acid such as acetic acid, sulfuric acid, or nitric acid. In some further embodiments, said solution may comprise an organic acid such as for example, formic acid, acetic acid, propionic acid, butyric acid, isobutyric acid, or the like.

In some embodiments, in the kit, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the kit can include a chemical agent that cleaves the chain terminating moieties. For example, the kit comprises any one or any combination of a phosphine compound, a phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the kit, the nucleotide analog comprise a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof.

In some embodiments, in the kit, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base.

In some embodiments, in the kit, the cleavable linker on the base comprises a cleavable moiety comprising an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the kit can also include a chemical agent that cleaves the cleavable linker on the base. For example, the kit comprises any one or any combination of tetrakis (triphenylphosphine)palladium(0) ($Pd(PPh_3)_4$) with piperidine, or with 2,3-Dichloro-5,6-dicyano-1,4-benzo-quinone (DDQ), H2 Pd/C, or a phosphine or with a thiol group including beta-mercaptoethanol or dithiothritol (DTT). In some embodiments, the kit includes a chemical agent comprising potassium carbonate ($K_2CO_3$) in MeOH, with triethylamine in pyridine, or with Zn in acetic acid (AcOH). In some embodiments, the kit includes a chemical agent comprising tetrabutylammonium fluoride, pyridine-HF, with ammonium fluoride, or with triethylamine trihydrofluoride.

In some embodiments, in the kit, the cleavable linker on the base comprises cleavable moiety including an azide, azido or azidomethyl group. In some embodiments, the kit can include a chemical agent that cleaves the cleavable linker on the base. For example, the kit comprises any one or any combination of a phosphine compound, a phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the kit, the chain terminating moiety (e.g., at the sugar 2' and/or sugar 3' position) and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

The present disclosure provides a kit comprising at least one mutant polymerase comprising an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523, and the kit further comprises a plurality of multivalent molecules. In some embodiments, at least one multivalent molecule in the plurality of multivalent molecules comprises: (a) a core; and (b) a plurality of nucleotide arms which comprise (i) a core attachment moiety, (ii) a spacer (e.g., comprising a PEG moiety), (iii) a linker, and (iv) a nucleotide unit, wherein the core is attached to the plurality of nucleotide arms, wherein the spacer is attached to the linker, wherein the linker is attached to the nucleotide unit. Exemplary multivalent molecules are shown in FIGS. 2-5. An exemplary nucleotide arm is shown in FIG. 6. An exemplary spacer is shown in FIG. 7 (top). Various exemplary linkers are shown in FIG. 7 (bottom) and FIG. 8. Examples of various linkers joined/attached to nucleotide units are shown in FIGS. 9A-D, where the 5 position of a pyrimidine base or the 7 position of a purine base is attached to the linker via a propargyl amine attachment (see also FIG. 10). In some embodiments, the nucleotide unit comprises a base, sugar and at least one phosphate group, and the linker is attached to the nucleotide unit through the base. In some embodiments, the linker comprises an aliphatic chain or an oligo ethylene glycol chain where both linker chains having 2-6 subunits. In some embodiments, the linkers further include an aromatic moiety.

In some embodiments, in the kit, individual multivalent molecules in the plurality of multivalent molecules comprise a core attached to multiple nucleotide arms, and wherein the multiple nucleotide arms have the same type of nucleotide unit which is selected from a group consisting of dATP, dGTP, dCTP, dTTP and dUTP.

In some embodiments in the kit, the nucleotide unit of the at least one multivalent molecule comprises an aromatic base, a five carbon sugar (e.g., ribose or deoxyribose), and one or more phosphate groups (e.g., 1-10 phosphate groups). The plurality of multivalent molecules can comprise one type multivalent molecule having one type of nucleotide unit selected from a group consisting of dATP, dGTP, dCTP, dTTP and dUTP. The plurality of nucleotides can comprise at a mixture of any combination of two or more types of multivalent molecules, where individual multivalent molecules in the mixture comprise nucleotide units selected from a group consisting of dATP, dGTP, dCTP, dTTP and/or dUTP.

In some embodiments, in the kit, at least one multivalent molecule in the plurality of multivalent molecules comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups substituted with analogs including phosphoramidate, phosphorothioate, phosphordithioate, and O-methylphosphoroamidite groups.

In some embodiments, in the kit, individual multivalent molecules in the plurality of multivalent molecule comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, in the kit, at least one multivalent molecule in the plurality of multivalent molecules comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the kit can also include a chemical agent that cleaves the chain terminating moieties of the nucleotide unit of the multivalent molecule. For example, the kit comprises any one or any combination of tetrakis(triphenylphosphine)palladium(0) (Pd(PPh$_3$)$_4$) with piperidine, or with 2,3-Dichloro-5,6-dicyano-1,4-benzo-quinone (DDQ), H2 Pd/C, or a phosphine or with a thiol group including beta-mercaptoethanol or dithiothritol (DTT). In some embodiments, the kit includes a chemical agent comprising potassium carbonate (K$_2$CO$_3$) in MeOH, with triethylamine in pyridine, or with Zn in acetic acid (AcOH). In some embodiments, the kit includes a chemical agent comprising tetrabutylammonium fluoride, pyridine-HF, with ammonium fluoride, or with triethylamine trihydrofluoride.

In some embodiments, in the kit, at least one multivalent molecule in the plurality of multivalent molecules comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the kit can include a chemical agent that cleaves the chain terminating moieties of the nucleotide unit of the multivalent molecule. For example, the kit comprises any one or any combination of a phosphine compound, a phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the kit, at least one multivalent molecule in the plurality of multivalent molecules comprises a nucleotide unit comprising a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof.

In some embodiments, in the kit, at least one multivalent molecule in the plurality of multivalent molecules comprises a core attached to multiple nucleotide arms. In some embodiments, the core, at least one linker and/or at least one nucleotide unit is labeled with detectable reporter moiety. In some embodiments, the detectable reporter moiety comprises a fluorophore.

In some embodiments, in the kit, individual multivalent molecules comprise a core having an avidin-like moiety and the core attachment moiety comprises biotin. In some embodiments, the core comprises an streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™.

In some embodiments, the kit comprises one or more containers that contain the at least one mutant polymerase, cations, primers, plurality of nucleotides and/or plurality of multivalent molecules. The mutant polymerase, cations, primers, and/or plurality of nucleotides can be combined in any combination and can be contained in a single container, or can be contained in separate container, or any combination thereof. The mutant polymerase, cations, primers, and/or plurality of multivalent molecules can be combined in any combination and can be contained in a single container, or can be contained in separate container, or any combination thereof.

The kit can include instructions for use of the kit for conducting a nucleotide binding reaction, a nucleotide incorporation reaction and/or a nucleic acid sequencing reaction using a plurality of nucleotides. The kit can include instructions for use of the kit for conducting a multivalent molecule binding reaction, a multivalent molecule incorporation reaction and/or a nucleic acid sequencing reaction using a plurality of multivalent molecules.

Nucleic Acids Encoding Engineered Polymerases, Vectors and Host Cells

The present disclosure provides nucleic acids encoding any of the mutant polymerases described herein which comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523.

The present disclosure provides a vector operably linked to at least one nucleic acid (e.g., a transgene) encoding any of the mutant polymerases described herein which comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the vector comprises at least one host cell regulatory sequence, including a promoter sequence, enhancer, transcription and/or translation initiation sequence, transcription and/or translation termination sequence, polypeptide secretion signal sequences, and the like. The promoter sequence can be a constitutive or inducible promoter sequence. In some embodiments, the promoter sequence in the vector can be operably linked to the at least one nucleic acid encoding the mutant polymerase to control expression of the mutant polymerase by the host cell. In some embodiments, the vector comprises an expression vector.

The present disclosure provides a host cell harboring the vector (e.g., expression vector) which is operably linked to at least one nucleic acid (e.g., a transgene) encoding any of the mutant polymerases described herein which comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the vector comprises a promoter sequence which is operably linked to the at least one nucleic acid encoding the mutant polymerase, where the promoter sequence controls expression of the mutant polymerase by the host cell.

The present disclosure provides a plurality of host cells, wherein individual host cells in the plurality of host cells harbor the vector (e.g., expression vector) which is operably linked to at least one nucleic acid (e.g., a transgene) encoding any of the mutant polymerases described herein which comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the vector comprises a promoter sequence which is operably linked to the at least one nucleic acid encoding the mutant polymerase, where the promoter sequence controls expression of the mutant polymerase by the host cell.

Methods

The present disclosure provides methods for preparing a plurality of mutant polymerases, comprising: culturing the plurality of host cells of, wherein individual host cells in the plurality of host cells harbor the vector (e.g., expression vector) which is operably linked to at least one nucleic acid (e.g., a transgene) encoding any of the mutant polymerases described herein which comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the vector in the host cell comprises a promoter sequence which is operably linked to the at least one nucleic acid encoding the mutant polymerase, where the promoter sequence controls expression of the mutant polymerase by the host cell. In some embodiments, the plurality of host cells is cultured under conditions suitable for expressing a plurality of mutant polymerases by the plurality of host cells. In some embodiments, the method further comprises recovering (e.g., isolating/enriching) the plurality of mutant polymerases from the plurality of host cells.

The present disclosure provides methods for binding nucleotide analogs, methods for incorporating nucleotide analogs, and methods for binding nucleotide units of a multivalent molecule. The methods described herein can be used to conduct primer extension reactions and nucleic acid sequencing reactions. Polymerases variously comprise DNA polymerases, RNA polymerases, template-independent polymerases, reverse transcriptases, or other enzymes capable of nucleotide extension. Wild type DNA polymerases generally do not tolerate certain types of nucleotide modifications, such as modifications to the 3' position of the sugar. This property requires that wild type DNA polymerases be significantly modified in order to facilitate reversible or irreversible terminator (removable chemical groups which prevent nucleic acid extension) incorporation for applications such as sequencing. Further provided herein are methods of sequencing employing mutant polymerases that incorporate modified nucleotides. Further, the use of engineered DNA polymerases allows the development of enzymes capable of incorporating modified nucleotides into an elongating nucleic acid chain without sacrificing the thermostability of the enzyme or the ability of the enzyme to function at higher temperatures. This property is especially enhanced when DNA polymerases are engineered based on archaeal polymerase backbones, and more especially backbones derived from the DNA polymerase sequences of thermophilic or thermotolerant archaea.

Engineered DNA polymerases that exhibit improved thermostability and/or improved ability to incorporation nucleotide analogs may be useful in isothermal sequencing or elongation techniques. Isothermal techniques include SDA, LAMP, SMAP, ICAN, SMART, among others, and may further include additional techniques as disclosed herein. In these techniques, the elongation reaction proceeds at a constant temperature, for example using strand displacement reactions, or in some additional exemplary embodiments, elongating from a primed, single stranded template, especially including a primed polyvalent template. In some embodiments, the engineered DNA polymerases have strand displacement capabilities. In amplification-dependent methods, isothermal amplification can be completed in a single step, by incubating the mixture of samples, primers, DNA polymerase with strand displacement activity, and substrates at a constant temperature. This reduces the number of steps required, eliminating thermal ramping steps and reducing the total cycle time for each sequencing or elongation cycle, while simultaneously decreasing the reaction time required for each cycle. In amplification-free methods, isothermal methods allow for the binding, detection, and elongation of a nascent nucleic acid strand during a sequencing cycle without lost time due to temperature ramping or additional thermal stress on key components or reagents.

The present disclosure provides engineered polymerase that are useful for conducting any nucleic acid sequencing method that employs labeled or non-labeled chain terminating nucleotides, where the chain terminating nucleotides include a 3'-O-azido group (or 3'-O-methylazido group) or any other type of bulky blocking group at the sugar 3' position. For example, the engineered polymerases can be used to conduct sequencing-by-avidity methods (SBA) using labeled multivalent molecules and non-labeled chain terminating nucleotides. Additionally, the engineered polymerases can be used for conducting sequencing-by-synthesis (SBS) methods which employ labeled chain-terminating nucleotides, and for conducting sequencing-by-binding methods (SBB) which employ non-labeled chain-terminating nucleotides.

Sequencing-by-avidity (SBA) of DNA ideally requires (a) the detection of the n+1 base and requires 2 or more copies of target nucleic acid sequence, two or more primer nucleic acid molecules that are complementary to one or more regions of said target nucleic acid sequence and two more polymerases contacting said composition with a multivalent molecule (e.g., a polymer-nucleotide conjugate) under conditions sufficient to allow a multivalent binding complex to be formed between said polymer-nucleotide conjugate and said two or more copies of said target nucleic acid sequence in said composition of wherein the polymer-nucleotide conjugate comprises two or more nucleotide moieties; the detection substrates is subsequently washed away and (b) to ensure only a single incorporation occurs, a structural modification ('blocking group') of the an unlabeled nucleotides is required to ensure a single nucleotide incorporation but which then prevents any further nucleotide incorporation into the polynucleotide chain. The blocking group must then be removable, under reaction conditions which do not interfere with the integrity of the DNA being sequenced. The sequencing cycle can then continue with the N+1 detection of the next multivalent polymerase-conjugate-DNA complex and so on. In order to be of practical use, the avidity step requires both (a) a stable substrate to persist for long enough to image for >30 s and (b) a stepping step whereby the entire process should consist of high yielding, highly specific chemical and enzymatic steps to facilitate multiple cycles of sequencing.

Sequencing-by-synthesis (SBS) of DNA ideally requires the controlled (i.e. one at a time) incorporation of the correct complementary nucleotide opposite the oligonucleotide being sequenced. This allows for accurate sequencing by adding nucleotides in multiple cycles as each nucleotide residue is sequenced one at a time, thus preventing an uncontrolled series of incorporations occurring. The incorporated nucleotide is read using an appropriate label attached thereto before removal of the label moiety and the subsequent next round of sequencing. In order to ensure only a single incorporation occurs, a structural modification ('blocking group') of the sequencing nucleotides is required to ensure a single nucleotide incorporation but which then prevents any further nucleotide incorporation into the polynucleotide chain. The blocking group must then be removable, under reaction conditions which do not interfere with the integrity of the DNA being sequenced. The sequencing cycle can then continue with the incorporation of the next blocked, labelled nucleotide. In order to be of practical use, the entire process should consist of high yielding, highly specific chemical and enzymatic steps to facilitate multiple cycles of sequencing.

Sequencing-by-binding (SBB) requires method for sequencing a nucleic acid that includes the steps of (a) sequentially contacting a primed template nucleic acid with at least two separate mixtures under ternary complex stabilizing conditions, wherein the at least two separate mixtures each include a polymerase and a nucleotide, whereby the sequentially contacting results in the primed template nucleic acid being contacted, under the ternary complex stabilizing conditions, with nucleotide cognates for first, second and third base type base types in the template; (b) examining the at least two separate mixtures to determine whether a ternary complex formed; and (c) identifying the next correct nucleotide for the primed template nucleic acid molecule, wherein the next correct nucleotide is identified as a cognate of the first, second or third base type if ternary complex is detected in step (b), and wherein the next correct nucleotide is imputed to be a nucleotide cognate of a fourth base type based on the absence of a ternary complex in step (b); (d) adding a next correct nucleotide to the primer of the primed template nucleic acid after step (b), thereby producing an extended primer; and (e) repeating steps (a) through (d) at least once on the primed template nucleic acid that comprises the extended primer. Exemplary sequencing-by-binding methods are described in U.S. Pat. Nos. 10,246,744 and 10,731,141 (where the contents of both patents are hereby incorporated by reference in their entireties).

Methods for Sequencing Using Phosphate-Chain Labeled Nucleotides

The present disclosure provides methods for sequencing using immobilized sequencing polymerases which bind non-immobilized template molecules, wherein the sequencing reactions are conducted with phosphate-chain labeled nucleotides. In some embodiments, the sequencing methods comprise step (a): providing a support having a plurality of sequencing polymerases immobilized thereon. In some embodiments, the sequencing polymerase comprises a processive DNA polymerase. In some embodiments, the sequencing polymerase comprises any of the wild type or mutant DNA polymerases described herein, including for example a Phi29 DNA polymerase. In some embodiments, the support comprise a plurality of separate compartments and a sequencing polymerase is immobilized to the bottom of a compartment. In some embodiments, the separate compartments comprise a silica bottom through which light can penetrate. In some embodiments, the separate compartments comprise a silica bottom configured with a nanophotonic confinement structure comprising a hole in a metal cladding film (e.g., aluminum cladding film). In some embodiments, the hole in the metal cladding has a small aperture, for example, approximately 70 nm. In some embodiments, the height of the nanophotonic confinement structure is approximately 100 nm. In some embodiments, the nanophotonic confinement structure comprises a zero mode waveguide (ZMW). In some embodiments, the nanophotonic confinement structure contains a liquid.

In some embodiments, the sequencing method further comprises step (b): contacting the plurality of immobilized sequencing polymerases with a plurality of single stranded circular nucleic acid template molecules and a plurality of oligonucleotide sequencing primers, under a condition suitable for individual immobilized sequencing polymerases to bind a single stranded circular template molecule, and suitable for individual sequencing primers to hybridize to individual single stranded circular template molecules, thereby generating a plurality of polymerase/template/primer complexes. In some embodiments, the individual sequencing primers hybridize to a universal sequencing primer binding site on the single stranded circular template molecule.

In some embodiments, the sequencing method further comprises step (c): contacting the plurality of polymerase/template/primer complexes with a plurality of phosphate chain labeled nucleotides each comprising an aromatic base, a five carbon sugar (e.g., ribose or deoxyribose), and phosphate chain comprising 3-20 phosphate groups, where the terminal phosphate group is linked to a detectable reporter moiety (e.g., a fluorophore). The first, second and third phosphate groups can be referred to as alpha, beta and gamma phosphate groups. In some embodiments, a particular detectable reporter moiety which is attached to the terminal phosphate group corresponds to the nucleotide base (e.g., dATP, dGTP, dCTP, dTTP or dUTP) to permit detection and identification of the nucleo-base. In some embodiments, the plurality of polymerase/template/primer complexes are contacted with the plurality of phosphate chain labeled nucleotides under a condition suitable for polymerase-catalyzed nucleotide incorporation. In some embodiments, the sequencing polymerases are capable of binding a complementary phosphate chain labeled nucleotide and incorporating the complementary nucleotide opposite a nucleotide in a template molecule. In some embodiment, the polymerase-catalyzed nucleotide incorporation reaction cleaves between the alpha and beta phosphate groups thereby releasing a multi-phosphate chain linked to a fluorophore.

In some embodiments, the sequencing method further comprises step (d): detecting the fluorescent signal emitted by the phosphate chain labeled nucleotide that is bound by the sequencing polymerase, and incorporated into the terminal end of the sequencing primer. In some embodiments, step (d) further comprises identifying the phosphate chain labeled nucleotide that is bound by the sequencing polymerase, and incorporated into the terminal end of the sequencing primer.

In some embodiments, the sequencing method further comprises step (d): repeating steps (c)—(d) at least once. In some embodiments, sequencing methods that employ phosphate chain labeled nucleotides can be conducted according to the methods described in U.S. Pat. Nos. 7,170,050; 7,302,146; and/or 7,405,281, where the contents of these patents are hereby incorporated by reference in their entireties.

DNA polymerases which may be used according to the methods and compositions of the present disclosure include viral, bacterial, archaeal and eukaryotic polymerases and homologs and orthologs thereof. In some embodiments, DNA polymerases include but are not limited to archaeal DNA polymerases such as *Thermococcus, Thermoplasmata, Pyrococcus*, Methanococcus, Hadesarchaea, Euryarchaeota, or Candidatus polymerases and homologs and orthologs thereof and engineered, mutated, and/or truncated variants thereof. Other DNA polymerases and homologous or orthologous polymerases are known in the art and are expressly contemplated within this disclosure.

Provided herein are methods that employ mutant polypeptides which have enhanced thermostability. In some embodiments, such mutant polypeptides possess polymerase activity (e.g., mutant nucleic acid polymerase). Thermostability in some embodiments includes increased Tm, resistance to degradation, and/or the ability to maintain functional activity (e.g., incorporation of nucleotides) at elevated temperatures relative to a nearest wild-type enzyme, such as a wild-type enzyme comprising a nearest wild-type enzyme sequence. Mutant polymerases in some embodiments comprise Tm that are increased about 1, 2, 5, 10, 15, 20, 25, or about 30 degrees C. relative to a nearest wild-type enzyme. Mutant polypeptides in some embodiments comprise a Tm that are increased at least 1, 2, 5, 10, 15, 20, 25, or at least 30 degrees C. relative to a nearest wild-type enzyme. Mutant polymerases often comprise a Tm value that are increased at least 1-10, 5-15, 4-20, 2-10, 4-15, 20-30, 10-60, or 25-35 degrees C. relative to a nearest wild-type enzyme. Polymerase activity, in some embodiments, comprises $k_{cat}$, $k_{cat}/K_m$, or yields of incorporated nucleotides for a given time period. In some embodiments, polymerase activity, in some embodiments, comprises $k_{cat}$, $k_{cat}/K_m$, or yields of incorporated modified nucleotides, such as 3'-O-azido or 3'-O-azidomethyl modified nucleotides, for a given time period. In some embodiments, mutant polymerases functioning at an elevated temperature maintain at least 99%, 98%, 95%, 90%, 85%, or at least 80% of the optimal activity of a nearest wild-type enzyme functioning at a lower temperature, utilizing unmodified nucleotides. For example, mutant polymerases functioning at about 37 degrees C. maintain at least 99%, 98%, 95%, 90%, 85%, or at least 80% of the optimal activity of a nearest wild-type enzyme utilizing unmodified nucleotides. In some embodiments, mutant polymerases functioning at about 42 degrees C. maintain at least 99%, 98%, 95%, 90%, 85%, or at least 80% of the optimal activity of a nearest wild-type enzyme utilizing unmodified nucleotides. In some embodiments, mutant polymerases functioning at about 55 degrees C. maintain at least 99%, 98%, 95%, 90%, 85%, or at least 80% of the optimal activity of a nearest wild-type enzyme utilizing unmodified nucleotides. In some embodiments, mutant polymerases functioning at about 60 degrees C. maintain at least 99%, 98%, 95%, 90%, 85%, or at least 80% of the optimal activity of a nearest wild-type enzyme utilizing unmodified nucleotides. In some embodiments, mutant polymerases functioning at least at 50 degrees C. maintain at least 99%, 98%, 95%, 90%, 85%, or at least 80% of the optimal activity of a nearest wild-type enzyme utilizing unmodified nucleotides. In some embodiments, mutant polymerases functioning at least at 60 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 37-95 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 37-95, 37-60, 37-55, 37-42, 40-60, 50-80, 42-55, 55-60, 55-95, 60-95, or 40-80 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 42-95 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 40-80 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 37-55 degrees C. maintain at least 99%, 98%, 95%, 90%, 85%, or at least 80% of the optimal activity of a nearest wild-type enzyme utilizing unmodified nucleotides. In some embodiments, mutant polymerases functioning at 50-95 degrees C. maintain at least 99%, 98%, 95%, 90%, 85%, or at least 80% of the optimal activity of a nearest wild-type enzyme utilizing unmodified nucleotides. In some embodiments, Mutant polymerases functioning at 60-95 degrees C. maintain at least 99%, 98%, 95%, 90%, 85%, or at least 80% of the optimal activity of a nearest wild-type enzyme utilizing unmodified nucleotides. In some embodiments a mutant polymerase has an increased $k_{cat}$ relative to a nearest related wild-type sequence functioning at a temperature of at least 37 degrees C. In some embodiments a mutant polymerase has an increased $k_{cat}$ relative to a nearest related wild-type sequence functioning at a temperature of at least 42 degrees C. In some embodiments a mutant polymerase has an increased $k_{cat}$ relative to a nearest related wild-type sequence functioning at a temperature of at least 55 degrees C. In some embodiments a mutant polymerase has an increased $k_{cat}$ relative to a nearest related wild-type sequence functioning at a temperature of at least 60 degrees C. In some embodiments a mutant polymerase has an increased $k_{cat}$ relative to a nearest related wild-type sequence functioning at a temperature of at least 80 degrees C. In some embodiments a mutant polymerase has an increased $k_{cat}$ relative to a nearest related wild-type sequence functioning at a temperature of at least 90 degrees C. In some embodiments a mutant polymerase has an increased $k_{cat}$ relative to a nearest related wild-type sequence functioning at a temperature of 37-95, 37-60, 37-55, 37-42, 40-60, 50-80, 42-55, 55-60, 55-95, 60-95, or 40-80 degrees C. In some embodiments a mutant polymerase has an increased $k_{cat}$ relative to a nearest related wild-type sequence functioning at a temperature of 37-55 degrees C. In some embodiments a mutant polymerase has an increased $k_{cat}$ relative to a nearest related wild-type sequence functioning at a temperature of 35-80 degrees C.

Methods for Forming Complexed Polymerases

The present disclosure provides methods for forming a plurality of complexed polymerases, comprising step (a): contacting a plurality of mutant polymerases with (i) a plurality of nucleic acid template molecules and (ii) a plurality of nucleic acid primers, under a condition suitable to bind the plurality of mutant polymerases to the plurality of nucleic acid template molecules and the plurality of nucleic acid primers, thereby forming a plurality of complexed polymerases each comprising a mutant polymerase bound to a nucleic acid duplex wherein the nucleic acid duplex comprises a nucleic acid template molecule hybridized to a nucleic acid primer. In some embodiments, the plurality of mutant polymerases comprise a DNA polymerase. In some embodiments, the plurality of mutant polymerases comprise a plurality of recombinant mutant polymerases. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523.

In some embodiments, in the methods for forming a plurality of complexed polymerases, the mutant polymerases include amino acid substitutions that confer exonuclease-minus activity. In some embodiments, the mutant polymerases exhibit desirable characteristics compared to a polymerase having a wild type amino acid backbone sequence. For example, the mutant polymerases exhibit increased thermal stability (Tm). In another example, the mutant polymerases exhibit increased incorporation rates of nucleotide analogs comprising a chain terminating moiety (e.g., blocking moiety) at the sugar 2' position and/or at the 3' sugar position. In yet another example, the mutant polymerases exhibit increased uracil-tolerance. In some embodiments, the mutant DNA polymerases exhibit improved binding to a nucleotide reagent. In some embodiments, the mutant DNA polymerases exhibit improved binding and incorporation of a nucleotide reagent. In some embodiments, the mutant DNA polymerases exhibit reduced sequence-specific sequencing errors. In some embodiments, the mutant DNA polymerases exhibit increased thermal stability at a temperature range of about 25-50° C. or about 45-75° C. compared to corresponding wild type polymerase comprising SEQ ID NO: 3-1315, 1317-2214, 2216-2366, 2368-2392, 2394-2407, 2409-2435, 2437-2454, 2456-2501 or 2511-2523.

In some embodiments, in the methods for forming a plurality of complexed polymerases, the nucleotide reagents comprise any one or any combination of nucleotides and/or multivalent molecules. In some embodiments, the nucleotides comprise canonical nucleotides. In some embodiments, the nucleotides comprise nucleotide analogs comprise detectably labeled nucleotides and/or nucleotides carrying a removable or non-removable chain terminating moiety. In some embodiments, individual multivalent molecules comprise a central core attached to multiple polymer arms each having a nucleotide unit at the end of the arms.

In some embodiments, in the methods for forming a plurality of complexed polymerases, the primer comprises a 3' extendible end or a 3' non-extendible end. In some embodiments, the plurality of nucleic acid template molecules comprise linear nucleic acid molecules or circular nucleic acid molecules. In some embodiments, the plurality of nucleic acid template molecules comprise amplified template molecules (e.g., clonally amplified template molecules). In some embodiments, the plurality of nucleic acid template molecules comprise one copy of a target sequence of interest. In some embodiments, the plurality of nucleic acid molecules comprise two or more tandem copies of a target sequence of interest (e.g., concatemers). In some embodiments, the nucleic acid template molecules in the plurality of nucleic acid template molecules comprise the same target sequence of interest or different target sequences of interest.

In some embodiments, in the methods for forming a plurality of complexed polymerases, the plurality of nucleic acid template molecules and/or the plurality of nucleic acid primers are in solution or are immobilized to a support. In some embodiments, when the plurality of nucleic acid template molecules and/or the plurality of nucleic acid primers are immobilized to a support, the binding with the recombinant mutant polymerase generates a plurality of immobilized complexed polymerases. In some embodiments, the plurality of nucleic acid template molecules and/or nucleic acid primers are immobilized to $10^2$-$10^{15}$ different sites on a support. In some embodiments, the binding of the plurality of template molecules and nucleic acid primers with the plurality of recombinant mutant polymerases generates a plurality of complexed polymerases immobilized to $10^2$-$10^{15}$ different sites on the support. In some embodiments, the plurality of immobilized complexed polymerases on the support are immobilized to pre-determined or to random sites on the support. In some embodiments, the plurality of immobilized complexed polymerases are in fluid communication with each other to permit flowing a solution of reagents (e.g., enzymes including polymerases, multivalent molecules, nucleotides, and/or divalent cations) onto the support so that the plurality of immobilized complexed polymerases on the support are reacted with the solution of reagents in a massively parallel manner.

Forming Complexed Polymerases with Multivalent Molecules

In some embodiments, the methods for forming a plurality of complexed polymerases generally comprise: (a) contacting a plurality of mutant polymerases with (i) a plurality of nucleic acid template molecules and (ii) a plurality of nucleic acid primers to form a plurality of complexed polymerases; (b1) contacting the plurality of complexed polymerases with a plurality of multivalent molecules to form a plurality of multivalent-complexed polymerases. In some embodiments, the method further comprises step (c1): detecting the multivalent molecules that are bound to the complexed polymerases. In some embodiments, the method further comprises step (d1): identifying the complementary nucleotide unit of the multivalent molecules that are bound to the complexed polymerases. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523.

In some embodiments, the methods for forming a plurality of complexed polymerases further comprise step (b1): contacting the plurality of complexed polymerases with a plurality of multivalent molecules, wherein individual multivalent molecules in the plurality comprise a core attached to multiple nucleotide arms and each nucleotide arm is attached to a nucleotide (e.g., a nucleotide unit). In some embodiments, the binding of the complementary nucleotide unit of the multivalent molecules to the complexed polymerases forms a plurality of multivalent-complexed polymerases. In some embodiments, the contacting in step (b1) is conducted under a condition suitable for binding a complementary nucleotide unit of at least one of the multivalent molecules to at least one of the complexed polymerases. In some embodiments, the condition is suitable for inhibiting incorporation of the complementary nucleotide units into the primers of the plurality of multivalent-complexed polymerases. In some embodiments, the contacting in step (b1) is conducted under a condition suitable for binding a nucleotide of at least one of the multivalent molecules to at least one of the complexed polymerases but the bound nucleotide does not incorporate into the 3' end of the nucleic acid primer.

In some embodiments, in the methods for forming a plurality of complexed polymerases, individual multivalent molecules in the plurality of multivalent molecules comprise: (a) a core; and (b) a plurality of nucleotide arms which comprise (i) a core attachment moiety, (ii) a spacer (e.g., comprising a PEG moiety), (iii) a linker, and (iv) a nucleotide, wherein the core is attached to the plurality of nucleotide arms via their core attachment moiety, wherein the spacer is attached to the linker, and wherein the linker is attached to the nucleotide. In some embodiments, the linker comprises an aliphatic chain having 2-6 subunits or an oligo ethylene glycol chain having 2-6 subunits. Exemplary multivalent molecules are shown in FIGS. 2-5. An exemplary nucleotide arm is shown in FIG. 6. An exemplary spacer is shown in FIG. 7 (top). Various exemplary linkers are shown in FIG. 7 (bottom) and FIG. 8. Examples of various linkers joined/attached to nucleotide units are shown in FIGS. 9A-D, where the 5 position of a pyrimidine base or the 7 position of a purine base is attached to the linker via a propargyl amine attachment (see also FIG. 10). In some embodiments, the plurality of nucleotide arms attached to a given core have the same type of nucleotide, and wherein the types of nucleotide comprise dATP, dGTP, dCTP, dTTP or dUTP. In some embodiments, the plurality of multivalent molecules comprise one type of a multivalent molecule wherein each multivalent molecule in the plurality has the same type of nucleotide unit selected from a group consisting of dATP, dGTP, dCTP, dTTP and dUTP. In some embodiments, the plurality of multivalent molecules comprise a mixture of any combination of two or more types of multivalent molecules each type having nucleotide units selected from a group consisting of dATP, dGTP, dCTP, dTTP and/or dUTP.

In some embodiments, in the methods for forming a plurality of complexed polymerases, the binding of the plurality of complexed polymerases with the plurality of multivalent molecules forms at least one avidity complex, the method comprising the steps: (a) binding a first nucleic acid primer, a first DNA polymerase, and a first multivalent molecule to a first portion of a concatemer template molecule thereby forming a first binding complex (e.g., FIGS. 61-63), wherein a first nucleotide unit of the first multivalent molecule binds to the first DNA polymerase; and (b) binding a second nucleic acid primer, a second DNA polymerase, and the first multivalent molecule to a second portion of the same concatemer template molecule thereby forming a second binding complex (e.g., FIGS. 61-63), wherein a second nucleotide unit of the first multivalent molecule binds to the second DNA polymerase, wherein the first and second binding complexes which include the same multivalent molecule forms an avidity complex (e.g., FIG. 64). In some embodiments, the first polymerase comprises any mutant polymerase described herein. In some embodiments, the second polymerase comprises any mutant polymerase described herein. The concatemer template molecule comprises tandem repeat sequences of a sequence of interest and at least one universal sequencing primer binding site. The first and second nucleic acid primers can bind to a sequencing primer binding site along the concatemer template molecule.

In some embodiments, in the methods for forming a plurality of complexed polymerases, the binding of the plurality of complexed polymerases with the plurality of multivalent molecules forms at least one avidity complex, the method comprising the steps: (a) binding a first nucleic acid primer, a first DNA polymerase, and a first multivalent molecule to a first template molecule thereby forming a first binding complex, wherein a first nucleotide unit of the first multivalent molecule binds to the first DNA polymerase; and (b) binding a second nucleic acid primer, a second DNA polymerase, and the first multivalent molecule to a second template molecule thereby forming a second binding complex, wherein a second nucleotide unit of the first multivalent molecule binds to the second DNA polymerase, wherein the first and second binding complexes which include the same multivalent molecule forms an avidity complex. In some embodiments, the first polymerase comprises any mutant polymerase described herein. In some embodiments, the second polymerase comprises any mutant polymerase described herein. In some embodiments, the first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second nucleic acid primers can bind to a sequencing primer binding site on the first and second template molecules, respectively.

In some embodiments, in the methods for forming a plurality of complexed polymerases, at least one of the multivalent molecules in the plurality of multivalent molecules is labeled with a detectable reporter moiety. In some embodiments, the detectable reporter moiety comprises a fluorophore. In some embodiments, the core of the multivalent molecule is labeled with a fluorophore, and wherein the fluorophore which is attached to a given core of the multivalent molecule corresponds to the nucleotide base (e.g., adenine, guanine, cytosine, thymine or uracil) of the nucleotide arm. In some embodiments, at least one of the nucleotide arms of the multivalent molecule comprises a linker and/or nucleotide base that is attached to a fluorophore, and wherein the fluorophore which is attached to a given nucleotide base corresponds to the nucleotide base (e.g., adenine, guanine, cytosine, thymine or uracil) of the nucleotide arm.

In some embodiments, in the methods for forming a plurality of complexed polymerases, the plurality of multivalent molecules comprise at least one multivalent molecule having multiple nucleotide arms each attached with a nucleotide analog (e.g., nucleotide analog unit), where the nucleotide analog includes a chain terminating moiety at the sugar 2' and/or 3' position. In some embodiments, the plurality of multivalent molecules comprises at least one multivalent molecule comprising multiple nucleotide arms each attached with a nucleotide unit that lacks a chain terminating moiety.

In some embodiments, in the methods for forming a plurality of complexed polymerases, the contacting of step (b1) is conducted in the presence of at least one cation selected from a group consisting of strontium, barium, sodium, magnesium, potassium, manganese, calcium, lithium, nickel and cobalt. In some embodiments, the contacting of step (b1) is conducted in the presence of strontium, barium and/or calcium.

In some embodiments, in the methods for forming a plurality of complexed polymerases, the contacting of step (a) is conducted at a constant temperature which is selected from a temperature range of about 25-80° C. In some embodiments, the contacting of step (b1) is conducted at a constant temperature which is selected from a temperature range of about 25-80° C. In some embodiments, the contacting of steps (a) and (b1) are conducted at a constant temperature which is selected from a temperature range of about 25-80° C. (e.g., isothermal temperature).

In some embodiments, the methods for forming a plurality of complexed polymerases further comprise step (c1): detecting the multivalent molecule which is bound to the complexed polymerase. In some embodiments, the detecting includes detecting the multivalent molecules that are bound to the complexed polymerases, where the complementary nucleotide units of the multivalent molecules are bound to the primers but incorporation of the complementary nucleotide units is inhibited. In some embodiments, the multivalent molecules are labeled with a detectable reporter moiety to permit detection. In some embodiments, the labeled multivalent molecules comprise a fluorophore attached to the core, linker and/or the base of the nucleotide unit of the multivalent molecules.

In some embodiments, the methods for forming a plurality of complexed polymerases further comprise step (d1): identifying the complementary nucleotide unit of the multivalent molecule which is bound to the complexed polymerase. In some embodiments, the identifying the complementary nucleotide unit of the multivalent molecule can be used to determine the sequence of the nucleic acid template. In some embodiments, the multivalent molecules are labeled with a detectable reporter moiety that corresponds to the particular nucleotide units attached to the nucleotide arms to permit identification of the complementary nucleotide units (e.g., nucleotide base adenine, guanine, cytosine, thymine or uracil) that are bound to the plurality of complexed polymerases. In some embodiments the detecting of step (c1) and the identifying of step (d1) can be used to determine the sequence of the nucleic acid template molecules.

In some embodiments, in the methods for forming a plurality of complexed polymerases, at least one multivalent molecule in the plurality of multivalent molecules of step (b1) comprises: (a) a core; and (b) a plurality of nucleotide arms which comprise (i) a core attachment moiety, (ii) a spacer (e.g., comprising a PEG moiety), (iii) a linker, and (iv) a nucleotide unit, wherein the core is attached to the plurality of nucleotide arms, wherein the spacer is attached to the linker, wherein the linker is attached to the nucleotide unit. Exemplary multivalent molecules are shown in FIGS. 2-5. An exemplary nucleotide arm is shown in FIG. 6. An exemplary spacer is shown in FIG. 7 (top). Various exemplary linkers are shown in FIG. 7 (bottom) and FIG. 8. Examples of various linkers joined/attached to nucleotide units are shown in FIGS. 9A-D, where the 5 position of a pyrimidine base or the 7 position of a purine base is attached to the linker via a propargyl amine attachment (see also FIG. 10). In some embodiments, the nucleotide unit comprises a base, sugar and at least one phosphate group, and the linker is attached to the nucleotide unit through the base. In some embodiments, the linker comprises an aliphatic chain or an oligo ethylene glycol chain where both linker chains having 2-6 subunits. In some embodiments, the linker also includes an aromatic moiety.

In some embodiments, in the methods for forming a plurality of complexed polymerases, individual multivalent molecules in the plurality of multivalent molecules of step (b1) comprise a core attached to multiple nucleotide arms, and wherein the multiple nucleotide arms have the same type of nucleotide unit which is selected from a group consisting of dATP, dGTP, dCTP, dTTP and dUTP.

In some embodiments, in the methods for forming a plurality of complexed polymerases, the nucleotide unit of the at least one multivalent molecule of step (b1) comprises an aromatic base, a five carbon sugar (e.g., ribose or deoxyribose), and one or more phosphate groups (e.g., 1-10 phosphate groups). The plurality of multivalent molecules can comprise one type multivalent molecule having one type of nucleotide unit selected from a group consisting of dATP, dGTP, dCTP, dTTP and dUTP. The plurality of multivalent molecules can comprise at a mixture of any combination of two or more types of multivalent molecules, where individual multivalent molecules in the mixture comprise nucleotide units selected from a group consisting of dATP, dGTP, dCTP, dTTP and/or dUTP.

In some embodiments, in the methods for forming a plurality of complexed polymerases, at least one multivalent molecule in the plurality of multivalent molecules of step (b1) comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups substituted with analogs including phosphoramidate, phosphorothioate, phosphordithioate, and O-methylphosphoroamidite groups.

In some embodiments, in the methods for forming a plurality of complexed polymerases, individual multivalent molecules in the plurality of multivalent molecule of step (b1) comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, in the methods for forming a plurality of complexed polymerases, at least one multivalent molecule in the plurality of multivalent molecules of step (b1) comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the chain terminating moiety is cleavable/removable from the nucleotide unit, for example by reacting the chain terminating moiety with a chemical agent, pH change, light or heat. In some embodiments, the chain terminating moieties alkyl, alkenyl, alkynyl and allyl are cleavable with tetrakis(triphenylphosphine) palladium(0) (Pd(PPh$_3$)$_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate (K$_2$CO$_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride.

In some embodiments, in the methods for forming a plurality of complexed polymerases, at least one multivalent molecule in the plurality of multivalent molecules of step (b1) comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri (hydroxyproyl)phosphine (THPP). In some embodiments, the cleaving agent comprises 4-dimethylaminopyridine (4-DMAP).

In some embodiments, in the methods for forming a plurality of complexed polymerases, at least one multivalent molecule in the plurality of multivalent molecules of step (b1) comprises a nucleotide unit comprising a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, and 3-O-benzyl, or derivatives thereof.

In some embodiments, in the methods for forming a plurality of complexed polymerases, at least one multivalent molecule in the plurality of multivalent molecules of step (b1) comprises a core attached to multiple nucleotide arms, wherein the core, linker and/or nucleotide unit is labeled with detectable reporter moiety. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments, in the methods for forming a plurality of complexed polymerases, at least one nucleotide arm of a multivalent molecule in the plurality of multivalent molecules of step (b1) has a nucleotide unit that is attached to a detectable reporter moiety. In some embodiments, the detectable reporter moiety is attached to the nucleotide base. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments, in the methods for forming a plurality of complexed polymerases, the core of a multivalent molecule of step (b1) comprises an avidin-like moiety and the core attachment moiety comprises biotin. In some embodiments, the core comprises an streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™

Forming Complexed Polymerases with Nucleotides

In some embodiments, the methods for forming a plurality of complexed polymerases generally comprise: (a) contacting a plurality of mutant polymerases with (i) a plurality of nucleic acid template molecules and (ii) a plurality of nucleic acid primers to form a plurality of complexed polymerases; (b2) contacting the plurality of complexed polymerases with a plurality of nucleotides to form a plurality of nucleotide-complexed polymerases. In some embodiments, the method further comprises step (c2): detecting the complementary nucleotides which are incorporated into the primers of the nucleotide-complexed polymerases. In some embodiments, the method further comprises step (d2): identifying the bases of the complementary nucleotides which are incorporated into the primers of the nucleotide-complexed polymerases. In some embodiments, the mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523.

In some embodiments, the methods for forming a plurality of complexed polymerases further comprise step (b2): contacting the plurality of complexed polymerases of step (a) with a plurality of nucleotides under a condition suitable for binding a complementary nucleotide from the plurality of nucleotides to a complexed polymerase from the plurality of complexed polymerases thereby forming a nucleotide-complexed polymerase. In some embodiments, the contacting of step (b2) is conducted under a condition that is suitable for promoting incorporation of the bound complementary nucleotides into the primers of the nucleotide-complexed polymerases thereby forming a plurality of nucleotide-complexed polymerases. In some embodiments, the incorporating the nucleotide into the 3' end of the primer in step (b2) comprises a primer extension reaction. In some embodiments, the contacting of step (b2) is conducted in the presence of at least one cation selected from a group consisting of strontium, barium, sodium, magnesium, potassium, manganese, calcium, lithium, nickel and cobalt. In some embodiments, the contacting of step (b2) is conducted in the presence of magnesium and/or manganese. In some embodiments, individual nucleotides in the plurality comprise an aromatic base, a five carbon sugar, and 1-10 phosphate groups. In some embodiments, the plurality of nucleotides comprises one type of nucleotide selected from a group consisting of dATP, dGTP, dCTP, dTTP and dUTP, or comprise a mixture of any combination of two or more types of nucleotides selected from a group consisting of dATP, dGTP, dCTP, dTTP and/or dUTP. In some embodiments, the plurality of nucleotides comprise native nucleotides (e.g., non-analog nucleotides) or nucleotide analogs. In some embodiments, individual nucleotides in the plurality of nucleotides comprise a chain terminating moiety attached to the 2' and/or 3' sugar position. In some embodiments, the plurality of nucleotides comprise a 2' and/or 3' chain terminating moiety which is removable or is not removable. In some embodiments, the chain terminating moiety comprises an azide, azido or azidomethyl group. In some embodiments, the azide, azido or azidomethyl group is removable from the nucleotide with a phosphine compound. One skilled in the art will recognize that other removable chain terminating moieties are possible. In some embodiments, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base or is not removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the methods for forming a plurality of complexed polymerases, the contacting of step (a) is conducted at a constant temperature which is selected from a temperature range of about 25-80° C. In some embodiments, the contacting of step (b2) is conducted at a constant temperature which is selected from a temperature range of about 25-80° C. In some embodiments, the contacting of steps (a) and (b2) are conducted at a constant temperature which is selected from a temperature range of about 25-80° C. (e.g., isothermal temperature).

In some embodiments, the methods for forming a plurality of complexed polymerases further comprise step (c2): detecting the complementary nucleotides which are incorporated into the primers of the nucleotide-complexed polymerases. In some embodiments, the plurality of nucleotides are labeled with a detectable reporter moiety to permit detection.

In some embodiments, the methods for forming a plurality of complexed polymerases further comprises the (d2): identifying the bases of the complementary nucleotides which are incorporated into the 3' end of the primers of the nucleotide-complexed polymerases. In some embodiments the detecting of step (c2) and the identifying of step (d2) can be used to determine the sequence of the nucleic acid template molecules.

In some embodiments, in the methods for forming a plurality of complexed polymerases, at least one nucleotide in the plurality of nucleotides of step (b2) comprise a base, sugar and at least one phosphate group. In some embodiments, at least one nucleotide in the plurality comprises an aromatic base, a five carbon sugar (e.g., ribose or deoxyribose), and one or more phosphate groups (e.g., 1-10 phosphate groups). The plurality of nucleotides can comprise at least one type of nucleotide selected from a group consisting of dATP, dGTP, dCTP, dTTP and dUTP. The plurality of nucleotides can comprise at a mixture of any combination of two or more types of nucleotides selected from a group consisting of dATP, dGTP, dCTP, dTTP and/or dUTP. In some embodiments, at least one nucleotide in the plurality is not a nucleotide analog. In some embodiments, at least one nucleotide in the plurality comprises a nucleotide analog.

In some embodiments, in the methods for forming a plurality of complexed polymerases, at least one nucleotide in the plurality of nucleotides of step (b2) comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups substituted with analogs including phosphoramidate, phosphorothioate, phosphordithioate, and O-methylphosphoroamidite groups.

In some embodiments, in the methods for forming a plurality of complexed polymerases, at least one nucleotide in the plurality of nucleotides of step (b2) comprises a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, silyl group or acetal group. In some embodiments, the chain terminating moiety is cleavable/removable from the nucleotide, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) $(Pd(PPh_3)_4)$ with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate ($K_2CO_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride. In some embodiments, the chain terminating moiety may be cleavable/removable with nitrous acid. In some embodiments, a chain terminating moiety may be cleavable/removable using a solution comprising nitrite, such as, for example, a combination of nitrite with an acid such as acetic acid, sulfuric acid, or nitric acid. In some further embodiments, said solution may comprise an organic acid.

In some embodiments, in the methods for forming a plurality of complexed polymerases, at least one nucleotide in the plurality of nucleotides of step (b2) comprises a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP). In some embodiments, the chain terminating moiety comprising one or more of a 3'-O-amino group, a 3'-O-aminomethyl group, a 3'-O-methylamino group, or derivatives thereof may be cleaved with nitrous acid, through a mechanism utilizing nitrous acid, or using a solution comprising nitrous acid. In some embodiments, the chain terminating moiety comprising one or more of a 3'-O-amino group, a 3'-O-aminomethyl group, a 3'-O-methylamino group, or derivatives thereof may be cleaved using a solution comprising nitrite. In some embodiments, for example, nitrite may be combined with or contacted with an acid such as acetic acid, sulfuric acid, or nitric acid. In some embodiments, the chain terminating moiety comprises a 3'-acetal moiety which can be cleaved with a palladium deblocking reagent (e.g., Pd(0)). In some further embodiments, for example, nitrite may be combined with or contacted with an organic acid such as, for example, formic acid, acetic acid, propionic acid, butyric acid, isobutyric acid, or the like.

In some embodiments, in the methods for forming a plurality of complexed polymerases, at least one nucleotide in the plurality of nucleotides of step (b2) comprises a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, 3'-O-benzyl, and 3'-acetal moiety, or derivatives thereof.

In some embodiments, in the methods for forming a plurality of complexed polymerases, at least one nucleotide in the plurality of nucleotides of step (b2) comprises a detectable reporter moiety. In some embodiments, at least one nucleotide in the plurality of nucleotides of step (b2) comprises a labeled nucleotide. In some embodiments, the detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the methods for forming a plurality of complexed polymerases, at least one nucleotide in the plurality of nucleotides of step (b2) comprises a cleavable linker on the base which comprises a cleavable (e.g., removable) moiety comprising an alkyl group, alkenyl group, alkynyl group, allyl group, aryl group, benzyl group, azide group, amine group, amide group, keto group, isocyanate group, phosphate group, thio group, disulfide group, carbonate group, urea group, silyl or acetal group. In some embodiments, the cleavable linker on the base is cleavable/removable from the base by reacting the cleavable moiety with a chemical agent, pH change, light or heat. In some embodiments, the cleavable moieties alkyl, alkenyl, alkynyl and allyl are cleavable with tetrakis(triphenylphosphine)palladium(0) (Pd(PPh$_3$)$_4$) with piperidine, or with 2,3-Dichloro-5,6-dicyano-1,4-benzo-quinone (DDQ). In some embodiments, the cleavable moieties aryl and benzyl are cleavable with H2 Pd/C. In some embodiments, the cleavable moieties amine, amide, keto, isocyanate, phosphate, thio, disulfide are cleavable with phosphine or with a thiol group including beta-mercaptoethanol or dithiothritol (DTT). In some embodiments, the cleavable moiety carbonate is cleavable with potassium carbonate ($K_2CO_3$) in MeOH, with triethylamine in pyridine, or with Zn in acetic acid (AcOH). In some embodiments, the cleavable moieties urea and silyl are cleavable with tetrabutylammonium fluoride, pyridine-HF, with ammonium fluoride, or with triethylamine trihydrofluoride.

In some embodiments, in the methods for forming a plurality of complexed polymerases, at least one nucleotide in the plurality of nucleotides of step (b2) comprises a cleavable linker on the base which comprises a cleavable moiety including an azide, azido or azidomethyl group. In some embodiments, the cleavable moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the methods for forming a plurality of complexed polymerases, at least one nucleotide in the plurality of nucleotides of step (b2) comprises a chain terminating moiety at the sugar 2' and/or the sugar 3' position, and a cleavable linker on the base, wherein the chain terminating moiety on the sugar and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

The present disclosure provides methods for binding a mutant polymerase to a nucleotide, comprising: (a) contacting a mutant polymerase to (i) a nucleic acid template molecule and (ii) a nucleic acid primer, wherein the contacting is conducted under a condition suitable to bind the mutant polymerase to the nucleic acid template molecule which is hybridized to the nucleic acid primer, wherein the nucleic acid template molecule hybridized to the nucleic acid primer forms the nucleic acid duplex. In some embodiments, the mutant polymerase comprises a recombinant mutant polymerase. In some embodiments, the primer comprises a 3' extendible end or a 3' non-extendible end. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases include amino acid substitutions that confer exonuclease-minus activity. In some embodiments, the mutant polymerase exhibits increased incorporation rate of nucleotide analogs compared to a corresponding wild type polymerase comprising SEQ ID NO: 1, 2, 1316, 2215, 2367, 2393, 2408 or 2436, where the nucleotide analogs comprise a chain terminating moiety (e.g., blocking moiety) at the sugar 2' position and/or at the 3' sugar position.

In some embodiments, the methods for binding a mutant polymerase to a nucleotide further comprise (b) contacting the mutant polymerase with a plurality of nucleotides under a condition suitable for binding at least one nucleotide to the mutant polymerase which is bound to the nucleic acid duplex. In some embodiments, the mutant polymerase is contacted with the plurality of nucleotides in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium. In some embodiments, the at least one nucleotide binds the mutant polymerase does not incorporate into the 3' end of the extendible or non-extendible primer. In some embodiments, the plurality of nucleotides comprises at least one nucleotide analog having a chain terminating moiety at the sugar 2' or 3' position. In some embodiments, the plurality of nucleotides comprises at least one nucleotide that lacks a chain terminating moiety. In some embodiments, the method further comprises (c) detecting the at least one nucleotide that is bound to the polymerase but has not incorporated into the 3' end of the primer. In some embodiments, the method further comprises (d) identifying the at least one nucleotide that is bound to the polymerase but has not incorporated into the 3' end of the primer.

Alternatively, the methods for binding a polymerase to a nucleotide, comprising forming a complexed polymerase: (al) contacting a mutant polymerase to (i) a nucleic acid template molecule and (ii) a nucleic acid primer, wherein the contacting is conducted under a condition suitable to bind the mutant polymerase to the nucleic acid template molecule which is hybridized to the nucleic acid primer, wherein the nucleic acid template molecule hybridized to the nucleic acid primer forms the nucleic acid duplex. In some embodiments, the mutant polymerase comprises a recombinant mutant polymerase. In some embodiments, the primer comprises a 3' extendible end or a 3' non-extendible end. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases include amino acid substitutions that confer exonuclease-minus activity. In some embodiments, the mutant polymerase exhibits increased incorporation rate of nucleotide analogs compared to a corresponding wild type polymerase comprising SEQ ID NO: 1, 2, 1316, 2215, 2367, 2393, 2408 or 2436, where the nucleotide analogs comprise a chain terminating moiety (e.g., blocking moiety) at the sugar 2' position and/or at the 3' sugar position.

The alternative method further comprises step (b1): contacting the plurality of complexed polymerases of step (al) with a plurality of nucleotides under a condition suitable for binding a complementary nucleotide from the plurality of nucleotides to a complexed polymerase from the plurality of complexed polymerases thereby forming a nucleotide-complexed polymerase. In some embodiments, the contacting of step (b1) is conducted under a condition that is suitable for promoting nucleotide binding but inhibiting incorporation of the bound complementary nucleotides to the 3' end of the primers of the nucleotide-complexed polymerases. In some embodiments, the contacting of step (b1) is conducted in the presence of at least one cation selected from a group consisting of strontium, barium, sodium, magnesium, potassium, manganese, calcium, lithium, nickel and cobalt. The plurality of complexed polymerases can be contacted sequentially with at least two separate mixtures where each mixture comprises an engineered polymerase and a nucleotide. The contacting is conducted under conditions suitable for forming stable ternary complexes with cognates for first, second and third base type base types in the template. The method further comprises step (c1) examining the at least two separate mixtures to determine if a ternary complex formed. The method further comprises step (d1) identifying the next correct nucleotide for the primed template nucleic acid molecule, wherein the next correct nucleotide is identified as a cognate of the first, second or third base type if ternary complex is detected in step (c1), and wherein the next correct nucleotide is imputed to be a nucleotide cognate of a fourth base type based on the absence of a ternary complex in step (c1). The method further comprises step (e1) adding a next correct nucleotide to the primer of the primed template nucleic acid after step (c3), thereby producing an extended primer; and step (f1) repeating steps (a) through (e1) for the primed template nucleic acid that comprises the extended primer.

The present disclosure provides methods for incorporating a nucleotide, comprising: (a) contacting a mutant polymerase to (i) a nucleic acid template molecule and (ii) a nucleic acid primer, wherein the contacting is conducted under a condition suitable to bind the mutant polymerase to the nucleic acid template molecule which is hybridized to the nucleic acid primer, wherein the nucleic acid template molecule hybridized to the nucleic acid primer forms the nucleic acid duplex. In some embodiments, the mutant polymerase comprises a recombinant mutant polymerase. In some embodiments, the primer comprises a 3' extendible end. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases include amino acid substitutions that confer exonuclease-minus activity. In some embodiments, the mutant polymerase exhibits increased incorporation rate of nucleotide analogs compared to a corresponding wild type polymerase comprising SEQ ID NO: 1, 2, 1316, 2215, 2367, 2393, 2408 or 2436, where the nucleotide analogs comprise a chain terminating moiety (e.g., blocking moiety) at the sugar 2' position and/or at the 3' sugar position.

In some embodiments, the methods for incorporating a nucleotide further comprise (b) contacting the mutant polymerase with a plurality of nucleotides under a condition suitable for binding at least one nucleotide to the mutant polymerase which is bound to the nucleic acid duplex. In some embodiments, the mutant polymerase is contacted with the plurality of nucleotides in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium. In some embodiments, the plurality of nucleotides comprises at least one nucleotide analog having a chain terminating moiety at the sugar 2' or 3' position. In some embodiments, the plurality of nucleotides comprises at least one nucleotide that lacks a chain terminating moiety. In some embodiments, the method further comprises (c) incorporating at least one nucleotide into the 3' end of the extendible primer under a condition suitable for incorporating the at least one nucleotide. In some embodiments, the suitable conditions for nucleotide binding the mutant polymerase and for incorporation the nucleotide can be the same or different. In some embodiments, conditions suitable for incorporating the nucleotide comprise inclusion of at least one cation selected from a group consisting of strontium, barium, sodium, magnesium, potassium, manganese, calcium, lithium, nickel and cobalt. In some embodiments, the at least one nucleotide binds the mutant polymerase and incorporates into the 3' end of the extendible primer. In some embodiments, the incorporating the nucleotide into the 3' end of the primer in step (c) comprises a primer extension reaction. In some embodiments, the method further comprises (d) repeating the incorporating at least one nucleotide into the 3' end of the extendible primer of step (c) at least once. In some embodiments, the method further comprises detecting the at least one incorporated nucleotide at step (c) and/or (d). In some embodiments, the method further comprises identifying the at least one incorporated nucleotide at step (c) and/or (d). In some embodiments, the sequence of the nucleic acid template molecule can be determined by detecting and identifying the nucleotide that binds the mutant polymerase. In some embodiments, the sequence of the nucleic acid template molecule can be determined by detecting and identifying the nucleotide that incorporates into the 3' end of the primer.

The present disclosure provides methods for determining the sequence of a nucleic acid template molecule, comprising: (a) contacting a mutant polymerase to (i) a nucleic acid template molecule and (ii) a nucleic acid primer, wherein the contacting is conducted under a condition suitable to bind the mutant polymerase to the nucleic acid template molecule which is hybridized to the nucleic acid primer, wherein the nucleic acid template molecule hybridized to the nucleic acid primer forms the nucleic acid duplex. In some embodiments, the mutant polymerase comprises a recombinant mutant polymerase. In some embodiments, the primer comprises a 3' extendible end. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the mutant polymerases include amino acid substitutions that confer exonuclease-minus activity. In some embodiments, the mutant polymerase exhibits increased incorporation rate of nucleotide analogs compared to a corresponding wild type polymerase comprising SEQ ID NO: 1, 2, 1316, 2215, 2367, 2393, 2408 or 2436, where the nucleotide analogs comprise a chain terminating moiety (e.g., blocking moiety) at the sugar 2' position and/or at the 3' sugar position.

In some embodiments, the methods for determining the sequence of a nucleic acid template molecule further comprise contacting the (b) contacting the mutant polymerase with a plurality of nucleotides under a condition suitable for binding at least one nucleotide to the mutant polymerase which is bound to the nucleic acid duplex. In some embodiments, the mutant polymerase is contacted with the plurality of nucleotides in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium. In some embodiments, the plurality of nucleotides comprises at least one nucleotide analog having a chain terminating moiety at the sugar 2' or 3' position. In some embodiments, the plurality of nucleotides comprises at least one nucleotide that lacks a chain terminating moiety. In some embodiments, the method further comprises (c) incorporating at least one nucleotide into the 3' end of the extendible primer under a condition suitable for incorporating the at least one nucleotide. In some embodiments, the suitable conditions for nucleotide binding the mutant polymerase and for incorporation the nucleotide can be the same or different. In some embodiments, conditions suitable for incorporating the nucleotide comprise inclusion of at least one cation selected from a group consisting of strontium, barium, sodium, magnesium, potassium, manganese, calcium, lithium, nickel and cobalt. In some embodiments, the at least one nucleotide binds the mutant polymerase and incorporates into the 3' end of the extendible primer. In some embodiments, the incorporating the nucleotide into the 3' end of the primer in step (c) comprises a primer extension reaction. In some embodiments, the method further comprises (d) repeating the incorporating at least one nucleotide into the 3' end of the extendible primer of step (c) at least once. In some embodiments, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base. In some embodiments, the method further comprises detecting the at least one incorporated nucleotide at step (c) and/or (d). In some embodiments, the method further comprises identifying the at least one incorporated nucleotide at step (c) and/or (d). In some embodiments, the sequence of the nucleic acid template molecule can be determined by detecting and identifying the nucleotide that binds the mutant polymerase, thereby determining the sequence of the nucleic acid template. In some embodiments, the sequence of the nucleic acid template molecule can be determined by detecting and identifying the nucleotide that incorporates into the 3' end of the primer, thereby determining the sequence of the nucleic acid template.

In some embodiments, in the methods for determining the sequence of a nucleic acid template, the plurality of polymerases that are bound to the nucleic acid duplexes comprise a plurality of complexed polymerases, having at least a first and second complexed polymerase, wherein (a) the first complexed polymerases comprises a first polymerase bound to a first nucleic acid duplex comprising a first nucleic acid template which is hybridized to a first nucleic acid primer, (b) the second complexed polymerases comprises a second polymerase bound to a second nucleic acid duplex comprising a second nucleic acid template which is hybridized to a second nucleic acid primer, (c) the first and second nucleic acid templates comprise different sequences, (d) the first and second nucleic acid templates are clonally-amplified, (e) the first and second primers comprise extendible 3' ends or non-extendible 3' ends, and (f) the plurality of complexed polymerases are immobilized to a support. In some embodiments, the density of the plurality of complexed polymerases is about $10^2$-$10^{15}$ complexed polymerases per mm$^2$ that are immobilized to the support.

In some embodiments, in the method for binding a nucleotide and in the method for incorporating a nucleotide and in the method for sequencing the nucleic acid template using nucleotides, at least one nucleotide in the plurality of nucleotides comprise a base, sugar and at least one phosphate group. In some embodiments, at least one nucleotide in the plurality comprises an aromatic base, a five carbon sugar (e.g., ribose or deoxyribose), and one or more phosphate groups (e.g., 1-10 phosphate groups). The plurality of nucleotides can comprise at least one type of nucleotide selected from a group consisting of dATP, dGTP, dCTP, dTTP and dUTP. The plurality of nucleotides can comprise at a mixture of any combination of two or more types of nucleotides selected from a group consisting of dATP, dGTP, dCTP, dTTP and/or dUTP. In some embodiments, at least one nucleotide in the plurality is not a nucleotide analog. In some embodiments, at least one nucleotide in the plurality comprises a nucleotide analog.

In some embodiments, in the method for binding a nucleotide and in the method for incorporating a nucleotide and in the method for sequencing the nucleic acid template, at least one nucleotide in the plurality of nucleotides comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups substituted with analogs including phosphoramidate, phosphorothioate, phosphordithioate, and O-methylphosphoroamidite groups.

In some embodiments, in the method for binding a nucleotide and in the method for incorporating a nucleotide and in the method for sequencing the nucleic acid template, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the chain terminating moiety is cleavable/removable from the nucleotide, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) ($Pd(PPh_3)_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate ($K_2CO_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride. In some embodiments, the chain terminating moiety may be cleavable/removable with nitrous acid. In some embodiments, a chain terminating moiety may be cleavable/removable using a solution comprising nitrite, such as, for example, a combination of nitrite with an acid such as acetic acid, sulfuric acid, or nitric acid. In some further embodiments, said solution may comprise an organic acid.

In some embodiments, in the method for binding a nucleotide and in the method for incorporating a nucleotide and in the method for sequencing the nucleic acid template, at least one nucleotide in the plurality of nucleotides comprises a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri (hydroxyproyl)phosphine (THPP). In some embodiments, the cleaving agent comprises 4-dimethylaminopyridine (4-DMAP). In some embodiments, the chain terminating moiety comprising one or more of a 3'-O-amino group, a 3'-O-aminomethyl group, a 3'-O-methylamino group, or derivatives thereof may be cleaved with nitrous acid, through a mechanism utilizing nitrous acid, or using a solution comprising nitrous acid. In some embodiments, the chain terminating moiety comprising one or more of a 3'-O-amino group, a 3'-O-aminomethyl group, a 3'-O-methylamino group, or derivatives thereof may be cleaved using a solution comprising nitrite. In some embodiments, for example, nitrite may be combined with or contacted with an acid such as acetic acid, sulfuric acid, or nitric acid. In some further embodiments, for example, nitrite may be combined with or contacted with an organic acid such as, for example, formic acid, acetic acid, propionic acid, butyric acid, isobutyric acid, or the like.

In some embodiments, in the method for binding a nucleotide and in the method for incorporating a nucleotide and in the method for sequencing the nucleic acid template, the nucleotide comprises a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, 3'-O-benzyl, and 3'-acetal moiety, or derivatives thereof.

In some embodiments, in the method for binding a nucleotide and in the method for incorporating a nucleotide and in the method for sequencing the nucleic acid template, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the method for binding a nucleotide and in the method for incorporating a nucleotide and in the method for sequencing the nucleic acid template, the cleavable linker on the base comprises a cleavable moiety comprising an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the cleavable linker on the base is cleavable/removable from the base by reacting the cleavable moiety with a chemical agent, pH change, light or heat. In some embodiments, the cleavable moieties alkyl, alkenyl, alkynyl and allyl are cleavable with tetrakis(triphenylphosphine)palladium(0) ($Pd(PPh_3)_4$) with piperidine, or with 2,3-Dichloro-5,6-dicyano-1,4-benzo-quinone (DDQ). In some embodiments, the cleavable moieties aryl and benzyl are cleavable with H2 Pd/C. In some embodiments, the cleavable moieties amine, amide, keto, isocyanate, phosphate, thio, disulfide are cleavable with phosphine or with a thiol group including beta-mercaptoethanol or dithiothritol (DTT). In some embodiments, the cleavable moiety carbonate is cleavable with potassium carbonate ($K_2CO_3$) in MeOH, with triethylamine in pyridine, or with Zn in acetic acid (AcOH). In some embodiments, the cleavable moieties urea and silyl are cleavable with tetrabutylammonium fluoride, pyridine-HF, with ammonium fluoride, or with triethylamine trihydrofluoride. In some embodiments, the chain terminating moiety comprises a 3'-acetal moiety which can be cleaved with a palladium deblocking reagent (e.g., Pd(0)).

In some embodiments, in the method for binding a nucleotide and in the method for incorporating a nucleotide and in the method for sequencing the nucleic acid template, the cleavable linker on the base comprises cleavable moiety including an azide, azido or azidomethyl group. In some embodiments, the cleavable moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the method for binding a nucleotide and in the method for incorporating a nucleotide and in the method for sequencing the nucleic acid template, the chain terminating moiety (e.g., at the sugar 2' and/or sugar 3' position) and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

In some embodiments, in the methods for forming a binding complex, the binding complex comprises a mutant polymerase, a nucleic acid template molecule duplexed with a primer, and a nucleotide reagent. In some embodiments, in the methods for forming a binding complex which comprises (i) a mutant polymerase, a nucleic acid template molecule duplexed with a primer, and a nucleotide, or the binding complex comprises (ii) a mutant polymerase, a nucleic acid template molecule duplexed with a primer, and a nucleotide unit of a multivalent molecule. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the binding complex has a persistence time of greater than about 0.1, 0.2, 0.3, 0.4, 0.5, 0.6, 0.7, 0.8, 0.9, 1 or 30 seconds or more than 30 seconds. The binding complex has a persistence time of greater than about 0.1-0.25 seconds, or about 0.25-0.5 seconds, or about 0.5-0.75 seconds, or about 0.75-1 second, or about 1-2 seconds, or about 2-3 seconds, or about 3-4 second, or about 4-5 seconds, or about 5-30 seconds, or more than 30 seconds and/or wherein the method is or may be carried out at a temperature of at or above 15° C., at or above 20° C., at or above 25° C., at or above 35° C., at or above 37° C., at or above 42° C. at or above 55° C. at or above 60° C., or at or above 72° C., or at or above 80° C., or within a range defined by any of the foregoing. In some embodiments, the binding complexes may have a persistence time of less than 1s, greater than 1s, greater than 2s, greater than 3s, greater than 5s, greater than 10s, greater than 15s, greater than 20s, greater than 30s, greater than 60s, greater than 120s, greater than 360s, greater than 3600s, or more, or for a time lying within a range defined by any two or more of these values. The binding complex (e.g., ternary complex) remains stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water. In some embodiments, the present disclosure provides said method wherein the binding complex is deposited on, attached to, or hybridized to, a surface showing a contrast to noise ratio in the detecting step of greater than 20. In some embodiments, the present disclosure provides said method wherein the contacting is performed under a condition that stabilizes the binding complex when the nucleotide or nucleotide unit is complementary to a next base of the template nucleic acid, and destabilizes the binding complex when the nucleotide or nucleotide unit is not complementary to the next base of the template nucleic acid.

In some embodiments, in the methods for forming a plurality of complexed polymerases, including methods that employ multivalent molecules and/or nucleotides, the support comprises a planar or non-planar support. The support can be solid or semi-solid. In some embodiments, the support can be porous, semi-porous or non-porous. In some embodiments, the surface of the support can be coated with one or more compounds to produce a passivated layer on the support. In some embodiments, the passivated layer forms a porous or semi-porous layer. In some embodiments, the nucleic acid primer, template and/or polymerase, can be attached to the passivated layer to immobilize the primer, template and/or polymerase to the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that can be used for immobilizing a plurality of nucleic acid template molecules to the support (e.g., FIG. 1). In some embodiments, the support can comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacetamidylpentyl)acrylamide-co-acrylamide (PAZAM). In some embodiments, the support comprises a surface coating having at least one hydrophilic polymer coating layer and at least one layer of a plurality of oligonucleotides. The hydrophilic polymer coating layer can comprise polyethylene glycol (PEG). The hydrophilic polymer coating layer can comprise branched PEG having at least 4 branches. In some embodiments, the low non-specific binding coating has a degree of hydrophilicity which can be measured as a water contact angle, where the water contact angle is no more than 45 degrees. In some embodiments, the density of the plurality of complexed polymerases immobilized to the support or immobilized to the coating on the support is about $10^2$-$10^6$ per mm$^2$, or about $10^6$-$10^9$ per mm$^2$, or about $10^9$-$10^{12}$ per mm$^2$, or about $10^{12}$-$10^{15}$ per mm$^2$ In some embodiments, the plurality of complexed polymerases is immobilized to the support or immobilized to the coating on the support at pre-determined sites on the support (or the coating on the support), or immobilized to the coating on the support at random sites on the support (or the coating on the support).

Methods for Conducting Nucleic Acid Sequencing

The present disclosure provides methods for determining the sequence of one or more nucleic acid template molecules, comprising: (a) contacting a plurality of a first mutant polymerase to (i) a plurality of nucleic acid template molecules and (ii) a plurality of nucleic acid primers, wherein the contacting is conducted under a condition suitable to bind the plurality of first mutant DNA polymerases to the plurality of nucleic acid template molecules and the plurality of nucleic acid primers thereby forming a plurality of first complexed polymerases each comprising a first mutant DNA polymerase bound to a nucleic acid duplex wherein the nucleic acid duplex comprises a nucleic acid template molecule hybridized to a nucleic acid primer. In some embodiments, the plurality of first mutant polymerases comprise a recombinant mutant polymerase. In some embodiments, the plurality of first mutant polymerases comprise a DNA polymerase. In some embodiments, the first mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the first mutant polymerases are recombinant polymerases. In some embodiments, the first mutant polymerases include amino acid substitutions that confer exonuclease-minus activity. In some embodiments, the first mutant polymerases exhibit desirable characteristics compared to a polymerase having a corresponding wild type amino acid backbone sequence (e.g., any of SEQ ID NOS: 1, 2, 1316, 2215, 2367, 2393, 2408 or 2436). For example, the first mutant polymerases exhibit increased thermal stability (Tm). In another example, the first mutant polymerases exhibit increased incorporation rates of nucleotide analogs comprising a chain terminating moiety (e.g., blocking moiety) at the sugar 2' position and/or at the 3' sugar position. In yet another example, the first mutant polymerases exhibit increased uracil-tolerance. In some embodiments, the mutant DNA polymerases exhibit improved binding to a nucleotide reagent. In some embodiments, the mutant DNA polymerases exhibit improved binding and incorporation of a nucleotide reagent. In some embodiments, the mutant DNA polymerases exhibit reduced sequence-specific sequencing errors.

In some embodiments, in the methods for determining the sequence of one or more nucleic acid template molecules, the nucleotide reagents comprise any one or any combination of nucleotides and/or multivalent molecules. In some embodiments, the nucleotides comprise canonical nucleotides. In some embodiments, the nucleotides comprise nucleotide analogs comprise detectably labeled nucleotides and/or nucleotides carrying a removable or non-removable chain terminating moiety. In some embodiments, individual multivalent molecules comprise a central core attached to multiple polymer arms each having a nucleotide unit at the end of the arms.

In some embodiments, in the methods for determining the sequence of one or more nucleic acid template molecules, the primer comprises a 3' extendible end or a 3' non-extendible end. In some embodiments, the plurality of nucleic acid template molecules comprise amplified template molecules (e.g., clonally amplified template molecules). In some embodiments, the plurality of nucleic acid template molecules comprise one copy of a target sequence of interest. In some embodiments, the plurality of nucleic acid molecules comprise two or more tandem copies of a target sequence of interest (e.g., concatemers). In some embodiments, the nucleic acid template molecules in the plurality of nucleic acid template molecules comprise the same target sequence of interest or different target sequences of interest. In some embodiments, the plurality of nucleic acid template molecules and/or the plurality of nucleic acid primers are in solution or are immobilized to a support. In some embodiments, when the plurality of nucleic acid template molecules and/or the plurality of nucleic acid primers are immobilized to a support, the binding with the first recombinant mutant polymerase generates a plurality of immobilized first complexed polymerases. In some embodiments, the plurality of nucleic acid template molecules and/or nucleic acid primers are immobilized to $10^2$-$10^{15}$ different sites on a support. In some embodiments, the binding of the plurality of template molecules and nucleic acid primers with the plurality of first recombinant mutant polymerases generates a plurality of first complexed polymerases immobilized to $10^2$-$10^{15}$ different sites on the support. In some embodiments, the plurality of immobilized first complexed polymerases on the support are immobilized to pre-determined or to random sites on the support. In some embodiments, the plurality of immobilized first complexed polymerases are in fluid communication with each other to permit flowing a solution of reagents (e.g., enzymes including polymerases, multivalent molecules, nucleotides, and/or divalent cations) onto the support so that the plurality of immobilized complexed polymerases on the support are reacted with the solution of reagents in a massively parallel manner.

In some embodiments, the methods for determining the sequence of one or more nucleic acid template molecules further comprises step (b): contacting the plurality of first complexed polymerases with a plurality of multivalent molecules to form a plurality of multivalent-complexed polymerases. In some embodiments, individual multivalent molecules in the plurality of multivalent molecules comprise a core attached to multiple nucleotide arms and each nucleotide arm is attached to a nucleotide (e.g., nucleotide unit). In some embodiments, the contacting of step (b) is conducted under a condition suitable for binding complementary nucleotide units of the multivalent molecules to at least two of the plurality of first complexed polymerases thereby forming a plurality of multivalent-complexed polymerases. In some embodiments, the condition is suitable for inhibiting incorporation of the complementary nucleotide units into the primers of the plurality of multivalent-complexed polymerases. In some embodiments, the plurality of multivalent molecules comprise at least one multivalent molecule having multiple nucleotide arms each attached with a nucleotide analog (e.g., nucleotide analog unit), where the nucleotide analog includes a chain terminating moiety at the sugar 2' and/or 3' position. In some embodiments, the plurality of multivalent molecules comprises at least one multivalent molecule comprising multiple nucleotide arms each attached with a nucleotide unit that lacks a chain terminating moiety. In some embodiments, at least one of the multivalent molecules in the plurality of multivalent molecules is labeled with a detectable reporter moiety. In some embodiments, the detectable reporter moiety comprises a fluorophore. In some embodiments, the contacting of step (b) is conducted in the presence of at least one cation selected from a group consisting of strontium, barium, sodium, magnesium, potassium, manganese, calcium, lithium, nickel and cobalt. In some embodiments, the contacting of step (b) is conducted in the presence of strontium, barium and/or calcium.

In some embodiments, the methods for determining the sequence of one or more nucleic acid template molecules further comprises step (c): detecting the plurality of multivalent-complexed polymerases. In some embodiments, the detecting includes detecting the multivalent molecules that are bound to the complexed polymerases, where the complementary nucleotide units of the multivalent molecules are bound to the primers but incorporation of the complementary nucleotide units is inhibited. In some embodiments, the multivalent molecules are labeled with a detectable reporter moiety to permit detection. In some embodiments, the labeled multivalent molecules comprise a fluorophore attached to the core, linker and/or nucleotide unit of the multivalent molecules.

In some embodiments, the methods for determining the sequence of one or more nucleic acid template molecules further comprises step (d): identifying the base of the complementary nucleotide units that are bound to the plurality of first complexed polymerases, thereby determining the sequence of the nucleic acid template. In some embodiments, the multivalent molecules are labeled with a detectable reporter moiety that corresponds to the particular nucleotide units attached to the nucleotide arms to permit identification of the complementary nucleotide units (e.g., nucleotide base adenine, guanine, cytosine, thymine or uracil) that are bound to the plurality of first complexed polymerases.

In some embodiments, in the methods for determining the sequence of one or more nucleic acid template molecules, the binding of the plurality of first complexed polymerases with the plurality of multivalent molecules forms at least one avidity complex, the method comprising the steps: (a) binding a first nucleic acid primer, a first DNA polymerase, and a first multivalent molecule to a first portion of a concatemer template molecule thereby forming a first binding complex (e.g., FIGS. 61-63), wherein a first nucleotide unit of the first multivalent molecule binds to the first DNA polymerase; and (b) binding a second nucleic acid primer, a second DNA polymerase, and the first multivalent molecule to a second portion of the same concatemer template molecule thereby forming a second binding complex (e.g., FIGS. 61-63), wherein a second nucleotide unit of the first multivalent molecule binds to the second DNA polymerase, wherein the first and second binding complexes which include the same multivalent molecule forms an avidity complex (e.g., FIG. 64). In some embodiments, the first polymerase comprises any mutant polymerase described herein. In some embodiments, the second polymerase comprises any mutant polymerase described herein. The concatemer template molecule comprises tandem repeat sequences of a sequence of interest and at least one universal sequencing primer binding site. The first and second nucleic acid primers can bind to a sequencing primer binding site along the concatemer template molecule.

In some embodiments, in the methods for determining the sequence of one or more nucleic acid template molecules, the method includes binding the plurality of first complexed polymerases with the plurality of multivalent molecules to form at least one avidity complex, the method comprising the steps: (a) contacting the plurality of DNA polymerases and the plurality of nucleic acid primers with different portions of a concatemer nucleic acid template molecule to form at least first and second complexed polymerases on the same concatemer template molecule (e.g., FIGS. 61-63); (b) contacting a plurality of multivalent molecules to the at least first and second complexed polymerases on the same concatemer template molecule, under conditions suitable to bind a single multivalent molecule from the plurality to the first and second complexed polymerases, wherein at least a first nucleotide unit of the single multivalent molecule is bound to the first complexed polymerase which includes a first primer hybridized to a first portion of the concatemer template molecule thereby forming a first binding complex (e.g., first ternary complex) (e.g., FIGS. 61-63), and wherein at least a second nucleotide unit of the single multivalent molecule is bound to the second complexed polymerase which includes a second primer hybridized to a second portion of the concatemer template molecule thereby forming a second binding complex (e.g., second ternary complex) (e.g., FIGS. 61-63), wherein the contacting is conducted under a condition suitable to inhibit polymerase-catalyzed incorporation of the bound first and second nucleotide units in the first and second binding complexes, and wherein the first and second binding complexes which are bound to the same multivalent molecule forms an avidity complex (e.g., FIG. 64); and (c) detecting the first and second binding complexes on the same concatemer template molecule, and (d) identifying the first nucleotide unit in the first binding complex thereby determining the sequence of the first portion of the concatemer template molecule, and identifying the second nucleotide unit in the second binding complex thereby determining the sequence of the second portion of the concatemer template molecule. In some embodiments, the plurality of DNA polymerases comprise any mutant polymerase described herein. The concatemer template molecule comprises tandem repeat sequences of a sequence of interest and at least one universal sequencing primer binding site. The plurality of nucleic acid primers can bind to a sequencing primer binding site along the concatemer template molecule.

In some embodiments, in the methods for determining the sequence of one or more nucleic acid template molecules, the binding of the plurality of first complexed polymerases with the plurality of multivalent molecules forms at least one avidity complex, the method comprising the steps: (a) binding a first nucleic acid primer, a first DNA polymerase, and a first multivalent molecule to a first template molecule thereby forming a first binding complex, wherein a first nucleotide unit of the first multivalent molecule binds to the first DNA polymerase; and (b) binding a second nucleic acid primer, a second DNA polymerase, and the first multivalent molecule to a second template molecule thereby forming a second binding complex, wherein a second nucleotide unit of the first multivalent molecule binds to the second DNA polymerase, wherein the first and second binding complexes which include the same multivalent molecule forms an avidity complex. In some embodiments, the first polymerase comprises any wild type or mutant polymerase described herein. In some embodiments, the second polymerase comprises any wild type or mutant polymerase described herein. In some embodiments, the first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second nucleic acid primers can bind to a sequencing primer binding site on the first and second template molecules, respectively.

In some embodiments, in the methods for determining the sequence of one or more nucleic acid template molecules, the method includes binding the plurality of first complexed polymerases with the plurality of multivalent molecules to form at least one avidity complex, the method comprising the steps: (a) contacting the plurality of DNA polymerases and the plurality of nucleic acid primers (which includes a first and second primer) with a first and second template molecule to form at least first and second complexed polymerases on the first and second template molecule, respectively; (b) contacting a plurality of multivalent molecules to the at least first and second complexed polymerases, under conditions suitable to bind a single multivalent molecule from the plurality to the first and second complexed polymerases, wherein at least a first nucleotide unit of the single multivalent molecule is bound to the first complexed polymerase which includes a first primer hybridized to the first template molecule thereby forming a first binding complex (e.g., first ternary complex), and wherein at least a second nucleotide unit of the single multivalent molecule is bound to the second complexed polymerase which includes a second primer hybridized to a second template molecule thereby forming a second binding complex (e.g., second ternary complex), wherein the contacting is conducted under a condition suitable to inhibit polymerase-catalyzed incorporation of the bound first and second nucleotide units in the first and second binding complexes, and wherein the first and second binding complexes which are bound to the same multivalent molecule forms an avidity complex; and (c) detecting the first and second binding complexes on the first and second template molecules, respectively, and (d) identifying the first nucleotide unit in the first binding complex thereby determining the sequence of the first template molecule, and identifying the second nucleotide unit in the second binding complex thereby determining the sequence of the second template molecule. In some embodiments, the plurality of DNA polymerases comprise any wild type or mutant polymerase described herein. The first and second template molecules are clonally amplified template molecules. In some embodiments, the first and second template molecules are localized in close proximity to each other. For example, the clonally-amplified first and second template molecules comprise linear template molecules that are generated via bridge amplification and are immobilized to the same location or feature on a support. The first and second template molecules comprise a sequence of interest and at least one universal sequencing primer binding site. The first and second nucleic acid primers can bind to a sequencing primer binding site on the first and second template molecules, respectively.

In some embodiments, the methods for determining the sequence of one or more nucleic acid template molecules further comprises step (e): dissociating the plurality of multivalent-complexed polymerases and removing the plurality of first mutant DNA polymerases and their bound multivalent molecules, and retaining the plurality of nucleic acid duplexes.

In some embodiments, the methods for determining the sequence of one or more nucleic acid template molecules further comprises step (f): contacting the plurality of the retained nucleic acid duplexes of step (e) with a plurality of second recombinant mutant DNA polymerases, wherein the contacting is conducted under a condition suitable for binding the plurality of second mutant DNA polymerases to the plurality of the retained nucleic acid duplexes, thereby forming a plurality of second complexed polymerases each comprising a second mutant DNA polymerase bound to a nucleic acid duplex. In some embodiments, the second mutant polymerases comprise an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the second mutant polymerases are recombinant polymerases. In some embodiments, the second mutant polymerases include amino acid substitutions that confer exonuclease-minus activity. In some embodiments, the second mutant polymerases exhibit desirable characteristics compared to a polymerase having a corresponding wild type amino acid backbone sequence (e.g., any of SEQ ID NOS: 1, 2, 1316, 2215, 2367, 2393, 2408 or 2436). For example, the second mutant polymerases exhibit increased thermal stability (Tm). In another example, the second mutant polymerases exhibit increased incorporation rates of nucleotide analogs comprising a chain terminating moiety (e.g., blocking moiety) at the sugar 2' position and/or at the 3' sugar position. In yet another example, the second mutant polymerases exhibit increased uracil-tolerance.

In some embodiments, the plurality of first mutant polymerases of step (a) have an amino acid sequence that is 100% identical to the amino acid sequence as the plurality of the second mutant polymerases of step (f). In some embodiments, the plurality of first mutant polymerases of step (a) have an amino acid sequence that differs from the amino acid sequence of the plurality of the second mutant polymerases of step (f).

In some embodiments, the methods for determining the sequence of one or more nucleic acid template molecules further comprises step (g): contacting the plurality of second complexed polymerases with a plurality of nucleotides, wherein the contacting is conducted under a condition suitable for binding complementary nucleotides from the plurality of nucleotides to at least two of the second complexed polymerases thereby forming a plurality of nucleotide-complexed polymerases. In some embodiments, the contacting of step (g) is conducted under a condition that is suitable for promoting incorporation of the bound complementary nucleotides into the primers of the nucleotide-complexed polymerases thereby forming a plurality of nucleotide-complexed polymerases. In some embodiments, the incorporating the nucleotide into the 3' end of the primer in step (g) comprises a primer extension reaction. In some embodiments, the contacting of step (g) is conducted in the presence of at least one cation selected from a group consisting of strontium, barium, sodium, magnesium, potassium, manganese, calcium, lithium, nickel and cobalt. In some embodiments, the contacting of step (g) is conducted in the presence of magnesium and/or manganese. In some embodiments, the plurality of nucleotides comprise native nucleotides (e.g., non-analog nucleotides) or nucleotide analogs. In some embodiments, the plurality of nucleotides comprise a 2' and/or 3' chain terminating moiety which is removable or is not removable. In some embodiments, the plurality of nucleotides comprises a plurality of nucleotides labeled with detectable reporter moiety. The detectable reporter moiety comprises a fluorophore. In some embodiments, the fluorophore is attached to the nucleotide base. In some embodiments, the fluorophore is attached to the nucleotide base with a linker which is cleavable/removable from the base or is not removable from the base. In some embodiments, at least one of the nucleotides in the plurality is not labeled with a detectable reporter moiety. In some embodiments, the plurality of nucleotides are non-labeled. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, the methods for determining the sequence of one or more nucleic acid template molecules further comprise step (h): detecting the complementary nucleotides which are incorporated into the primers of the nucleotide-complexed polymerases. In some embodiments, the plurality of nucleotides are labeled with a detectable reporter moiety to permit detection. In some embodiments, in the methods for determining the sequence of one or more nucleic acid template molecules, the detecting step is omitted.

In some embodiments, the methods for determining the sequence of one or more nucleic acid template molecules further comprises step (1): identifying the bases of the complementary nucleotides which are incorporated into the primers of the nucleotide-complexed polymerases. In some embodiments, the identification of the incorporated complementary nucleotides in step (i) can be used to confirm the identity of the complementary nucleotides of the multivalent molecules that are bound to the plurality of first complexed polymerases in step (d). In some embodiments, the identifying of step (i) can be used to determine the sequence of the nucleic acid template molecules. In some embodiments, in the methods for determining the sequence of one or more nucleic acid template molecules, the identifying step is omitted.

In some embodiments, the methods for determining the sequence of one or more nucleic acid template molecules further comprises step (j): removing the chain terminating moiety from the incorporated nucleotide when step (g) is conducted by contacting the plurality of second complexed polymerases with a plurality of nucleotides that comprise at least one nucleotide having a 2' and/or 3' chain terminating moiety.

In some embodiments, the methods for determining the sequence of one or more nucleic acid template molecules further comprises step (k): repeating steps (a)— (j) at least once. In some embodiments, the sequence of the nucleic acid template molecules can be determined by detecting and identifying the multivalent molecules that bind the mutant polymerases but do not incorporate into the 3' end of the primer at steps (c) and (d). In some embodiments, the sequence of the nucleic acid template molecule can be determined (or confirmed) by detecting and identifying the nucleotide that incorporates into the 3' end of the primer at steps (h) and (i).

In some embodiments, in the methods for determining the sequence of one or more nucleic acid template molecules, at least one multivalent molecule in the plurality of multivalent molecules of step (b) comprises: (1) a core; and (2) a plurality of nucleotide arms which comprise (i) a core attachment moiety, (ii) a spacer (e.g., comprising a PEG moiety), (iii) a linker, and (iv) a nucleotide unit, wherein the core is attached to the plurality of nucleotide arms, wherein the spacer is attached to the linker, wherein the linker is attached to the nucleotide unit. In some embodiments, the nucleotide unit comprises a base, sugar and at least one phosphate group, and the linker is attached to the nucleotide unit through the base. In some embodiments, the linker comprises an aliphatic chain or an oligo ethylene glycol chain where both linker chains having 2-6 subunits. In some embodiments, the linker also includes an aromatic moiety.

In some embodiments, in the methods for determining the sequence of one or more nucleic acid template molecules, individual multivalent molecules in the plurality of multivalent molecules of step (b) comprise a core attached to multiple nucleotide arms, and wherein the multiple nucleotide arms have the same type of nucleotide unit which is selected from a group consisting of dATP, dGTP, dCTP, dTTP and dUTP.

In some embodiments, in the methods for determining the sequence of one or more nucleic acid template molecules, the nucleotide unit of the at least one multivalent molecule of step (b) comprises an aromatic base, a five carbon sugar (e.g., ribose or deoxyribose), and one or more phosphate groups (e.g., 1-10 phosphate groups). The plurality of multivalent molecules can comprise one type multivalent molecule having one type of nucleotide unit selected from a group consisting of dATP, dGTP, dCTP, dTTP and dUTP. The plurality of multivalent molecules can comprise at a mixture of any combination of two or more types of multivalent molecules, where individual multivalent molecules in the mixture comprise nucleotide units selected from a group consisting of dATP, dGTP, dCTP, dTTP and/or dUTP.

In some embodiments, in the methods for determining the sequence of one or more nucleic acid template molecules, at least one multivalent molecule in the plurality of multivalent molecules of step (b) comprise a nucleotide unit having a chain of one, two or three phosphorus atoms where the chain is typically attached to the 5' carbon of the sugar moiety via an ester or phosphoramide linkage. In some embodiments, at least one nucleotide unit is a nucleotide analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups substituted with analogs including phosphoramidate, phosphorothioate, phosphordithioate, and O-methylphosphoroamidite groups.

In some embodiments, in the methods for determining the sequence of one or more nucleic acid template molecules, individual multivalent molecules in the plurality of multivalent molecule of step (b) comprise a core attached to multiple nucleotide arms, and wherein individual nucleotide arms comprise a nucleotide unit having a chain terminating moiety (e.g., blocking moiety) at the sugar 2' position, at the sugar 3' position, or at the sugar 2' and 3' position.

In some embodiments, in the methods for determining the sequence of one or more nucleic acid template molecules, at least one multivalent molecule in the plurality of multivalent molecules of step (b) comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the chain terminating moiety is cleavable/removable from the nucleotide unit, for example by reacting the chain terminating moiety with a chemical agent, pH change, light or heat. In some embodiments, the chain terminating moieties alkyl, alkenyl, alkynyl and allyl are cleavable with tetrakis(triphenylphosphine) palladium(0) ($Pd(PPh_3)_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate ($K_2CO_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride. In some embodiments, the chain terminating moiety may be cleavable/removable with nitrous acid. In some embodiments, a chain terminating moiety may be cleavable/removable using a solution comprising nitrite, such as, for example, a combination of nitrite with an acid such as acetic acid, sulfuric acid, or nitric acid. In some further embodiments, said solution may comprise an organic acid.

In some embodiments, in the methods for determining the sequence of one or more nucleic acid template molecules, at least one multivalent molecule in the plurality of multivalent molecules of step (b) comprises a nucleotide unit comprising a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri (hydroxyproyl)phosphine (THPP). In some embodiments, the cleaving agent comprises 4-dimethylaminopyridine (4-DMAP). In some embodiments, the chain terminating moiety comprising one or more of a 3'-O-amino group, a 3'-O-aminomethyl group, a 3'-O-methylamino group, or derivatives thereof may be cleaved with nitrous acid, through a mechanism utilizing nitrous acid, or using a solution comprising nitrous acid. In some embodiments, the chain terminating moiety comprising one or more of a 3'-O-amino group, a 3'-O-aminomethyl group, a 3'-O-methylamino group, or derivatives thereof may be cleaved using a solution comprising nitrite. In some embodiments, for example, nitrite may be combined with or contacted with an acid such as acetic acid, sulfuric acid, or nitric acid. In some further embodiments, for example, nitrite may be combined with or contacted with an organic acid such as, for example, formic acid, acetic acid, propionic acid, butyric acid, isobutyric acid, or the like. In some embodiments, the chain terminating moiety comprises a 3'-acetal moiety which can be cleaved with a palladium deblocking reagent (e.g., Pd(0)).

In some embodiments, in the methods for determining the sequence of one or more nucleic acid template molecules, at least one multivalent molecule in the plurality of multivalent molecules of step (b) comprises a nucleotide unit comprising a chain terminating moiety which is selected from a group consisting of 3'-deoxy nucleotides, 2',3'-dideoxynucleotides, 3'-methyl, 3'-azido, 3'-azidomethyl, 3'-O-azidoalkyl, 3'-O-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, 3'-O-benzyl, and 3'-acetal moiety, or derivatives thereof.

In some embodiments, in the methods for determining the sequence of one or more nucleic acid template molecules, at least one multivalent molecule in the plurality of multivalent molecules of step (b) comprises a core attached to multiple nucleotide arms, wherein the nucleotide arms comprise a spacer, linker and nucleotide unit, and wherein the core, linker and/or nucleotide unit is labeled with detectable reporter moiety. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments, in the methods for determining the sequence of one or more nucleic acid template molecules, at least one nucleotide arm of a multivalent molecule in the plurality of multivalent molecules of step (b) has a nucleotide unit that is attached to a detectable reporter moiety. In some embodiments, the detectable reporter moiety is attached to the nucleotide base. In some embodiments, the detectable reporter moiety comprises a fluorophore. In some embodiments, a particular detectable reporter moiety (e.g., fluorophore) that is attached to the multivalent molecule can correspond to the base (e.g., dATP, dGTP, dCTP, dTTP or dUTP) of the nucleotide unit to permit detection and identification of the nucleotide base.

In some embodiments, in the methods for determining the sequence of one or more nucleic acid template molecules, the core of a multivalent molecule of step (b) comprises an avidin-like moiety and the core attachment moiety comprises biotin. In some embodiments, the core comprises an streptavidin-type or avidin-type moiety which includes an avidin protein, as well as any derivatives, analogs and other non-native forms of avidin that can bind to at least one biotin moiety. Other forms of avidin moieties include native and recombinant avidin and streptavidin as well as derivatized molecules, e.g. non-glycosylated avidin and truncated streptavidins. For example, avidin moiety includes de-glycosylated forms of avidin, bacterial streptavidin produced by *Streptomyces* (e.g., *Streptomyces avidinii*), as well as derivatized forms, for example, N-acyl avidins, e.g., N-acetyl, N-phthalyl and N-succinyl avidin, and the commercially-available products ExtrAvidin™, Captavidin™, Neutravidin™, and Neutralite Avidin™.

In some embodiments, in the methods for determining the sequence of one or more nucleic acid template molecules, the each of the steps (a)-(j) are conducted at a temperature which is selected from a temperature range of about 25-80° C. In some embodiments, the contacting of steps (a) and (b) are conducted at a constant temperature which is selected from a temperature range of about 25-80° C. (e.g., isothermal temperature). In some embodiments, the detecting and identifying of steps (c) and (d) are conducted at a constant temperature which is selected from a temperature range of about 25-80° C. (e.g., isothermal temperature). In some embodiments, the dissociating of step (e) is conducted at a constant temperature which is selected from a temperature range of about 25-80° C. (e.g., isothermal temperature). In some embodiments, the contacting of steps (f) and (g) are conducted at a constant temperature which is selected from a temperature range of about 25-80° C. (e.g., isothermal temperature). In some embodiments, the detecting and identifying of steps (h) and (i) are conducted at a constant temperature which is selected from a temperature range of about 25-80° C. (e.g., isothermal temperature). In some embodiments, the removing of step (j) is conducted at a constant temperature which is selected from a temperature range of about 25-80° C. (e.g., isothermal temperature). In some embodiments, the steps (a)-(j) are conducted at a constant temperature which is selected from a temperature range of about 25-80° C. (e.g., isothermal temperature).

In some embodiments, a sequencing reaction or a binding assay can be conducted by binding a plurality of fluorescently-labeled multivalent molecules to a mutant polymerase, and the resulting binding complexes can exhibit reduced error rate, reduced phasing and/or improved signal intensity compared to conducting the same sequencing reaction or assay with a corresponding wild type polymerase or a reference polymerase.

In some embodiments, the mutant polymerases used to conduct the sequencing reaction or assay comprise an amino acid sequence that is at least 99%, at least 98%, at least 97%, at least 95%, at least 90% at least 85%, at least 80%, at least 75%, at least 70% identical to any of SEQ ID NOS:1-1315 (e.g., RLF 89458.1 or RLF 78286.1 backbone sequences).

In some embodiments, the mutant polymerases used to conduct the sequencing reaction or assay comprise an amino acid sequence that is at least 99%, at least 98%, at least 97%, at least 95%, at least 90% at least 85%, at least 80%, at least 75%, at least 70% identical to any of SEQ ID NOS:1316-2214 (e.g., NOZ 58130 backbone sequence).

In some embodiments, the mutant polymerases used to conduct the sequencing reaction or assay comprise an amino acid sequence that is at least 99%, at least 98%, at least 97%, at least 95%, at least 90% at least 85%, at least 80%, at least 75%, at least 70% identical to any of SEQ ID NOS:2215-2366 (e.g., RMF 90817 backbone sequence).

In some embodiments, the mutant polymerases used to conduct the sequencing reaction or assay comprise an amino acid sequence that is at least 99%, at least 98%, at least 97%, at least 95%, at least 90% at least 85%, at least 80%, at least 75%, at least 70% identical to any of SEQ ID NOS:2367-2392 (e.g., MBC 7218772 backbone sequence).

In some embodiments, the mutant polymerases used to conduct the sequencing reaction or assay comprise an amino acid sequence that is at least 99%, at least 98%, at least 97%, at least 95%, at least 90% at least 85%, at least 80%, at least 75%, at least 70% identical to any of SEQ ID NOS:2393-2407 and 2511-2523 (e.g., WP 175059460 backbone sequence).

In some embodiments, the mutant polymerases used to conduct the sequencing reaction or assay comprise an amino acid sequence that is at least 99%, at least 98%, at least 97%, at least 95%, at least 90% at least 85%, at least 80%, at least 75%, at least 70% identical to any of SEQ ID NOS:2408-2435 (e.g., KUO 42443 backbone sequence).

In some embodiments, the mutant polymerases used to conduct the sequencing reaction or assay comprise an amino acid sequence that is at least 99%, at least 98%, at least 97%, at least 95%, at least 90% at least 85%, at least 80%, at least 75%, at least 70% identical to any of SEQ ID NOS:2436-2454 (e.g., NOZ 77387 backbone sequence).

In some embodiments, in the methods for determining the sequence of one or more nucleic acid template molecules, at least one nucleotide in the plurality of nucleotides of step (g) comprise a base, sugar and at least one phosphate group. In some embodiments, at least one nucleotide in the plurality comprises an aromatic base, a five carbon sugar (e.g., ribose or deoxyribose), and one or more phosphate groups (e.g., 1-10 phosphate groups). The plurality of nucleotides can comprise at least one type of nucleotide selected from a group consisting of dATP, dGTP, dCTP, dTTP and dUTP. The plurality of nucleotides can comprise at a mixture of any combination of two or more types of nucleotides selected from a group consisting of dATP, dGTP, dCTP, dTTP and/or dUTP. In some embodiments, at least one nucleotide in the plurality is not a nucleotide analog. In some embodiments, at least one nucleotide in the plurality comprises a nucleotide analog.

In some embodiments, in the methods for determining the sequence of one or more nucleic acid template molecules, at least one nucleotide in the plurality of nucleotides of step (g) comprise a chain of one, two or three phosphorus atoms where the chain is typically attached to the 5' carbon of the sugar moiety via an ester or phosphoramide linkage. In some embodiments, at least one nucleotide in the plurality is an analog having a phosphorus chain in which the phosphorus atoms are linked together with intervening O, S, NH, methylene or ethylene. In some embodiments, the phosphorus atoms in the chain include substituted side groups including 0, S or $BH_3$. In some embodiments, the chain includes phosphate groups substituted with analogs including phosphoramidate, phosphorothioate, phosphordithioate, and O-methylphosphoroamidite groups.

In some embodiments, in the methods for determining the sequence of one or more nucleic acid template molecules, at least one nucleotide in the plurality of nucleotides of step (g) comprises a terminator nucleotide analog having a chain terminating moiety (e.g., blocking moiety) at the sugar 2' position, at the sugar 3' position, or at the sugar 2' and 3' position. In some embodiments, the chain terminating moiety can inhibit polymerase-catalyzed incorporation of a subsequent nucleotide unit or free nucleotide in a nascent strand during a primer extension reaction. In some embodiments, the chain terminating moiety is attached to the 3' sugar hydroxyl position where the sugar comprises a ribose or deoxyribose sugar moiety. In some embodiments, the chain terminating moiety is removable/cleavable from the 3' sugar hydroxyl position to generate a nucleotide having a 3'OH sugar group which is extendible with a subsequent nucleotide in a polymerase-catalyzed nucleotide incorporation reaction. In some embodiments, the chain terminating moiety comprises an alkyl group, alkenyl group, alkynyl group, allyl group, aryl group, benzyl group, azide group, amine group, amide group, keto group, isocyanate group, phosphate group, thio group, disulfide group, carbonate group, urea group, silyl or acetal group. In some embodiments, the chain terminating moiety is cleavable/removable from the nucleotide, for example by reacting the chain terminating moiety with a chemical agent, pH change, light or heat. In some embodiments, the chain terminating moieties alkyl, alkenyl, alkynyl and allyl are cleavable with tetrakis(triphenylphosphine)palladium(0) ($Pd(PPh_3)_4$) with piperidine, or with 2,3-Dichloro-5,6-dicyano-1,4-benzo-quinone (DDQ). In some embodiments, the chain terminating moieties aryl and benzyl are cleavable with H2 Pd/C. In some embodiments, the chain terminating moieties amine, amide, keto, isocyanate, phosphate, thio, disulfide are cleavable with phosphine or with a thiol group including beta-mercaptoethanol or dithiothritol (DTT). In some embodiments, the chain terminating moiety carbonate is cleavable with potassium carbonate ($K_2CO_3$) in MeOH, with triethylamine in pyridine, or with Zn in acetic acid (AcOH). In some embodiments, the chain terminating moieties urea and silyl are cleavable with tetrabutylammonium fluoride, pyridine-HF, with ammonium fluoride, or with triethylamine trihydrofluoride. In some embodiments, the chain terminating moiety may be cleavable/removable with nitrous acid. In some embodiments, a chain terminating moiety may be cleavable/removable using a solution comprising nitrite, such as, for example, a combination of nitrite with an acid such as acetic acid, sulfuric acid, or nitric acid. In some further embodiments, said solution may comprise an organic acid.

In some embodiments, in the methods for determining the sequence of one or more nucleic acid template molecules, at least one nucleotide in the plurality of nucleotides of step (g) comprises a terminator nucleotide analog having a chain terminating moiety (e.g., blocking moiety) at the sugar 2' position, at the sugar 3' position, or at the sugar 2' and 3' position. In some embodiments, the chain terminating moiety comprises an azide, azido or azidomethyl group. In some embodiments, the chain terminating moiety comprises a 3'-O-azido or 3'-O-azidomethyl group. In some embodiments, the chain terminating moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP). In some embodiments, the chain terminating moiety comprising one or more of a 3'-O-amino group, a 3'-O-aminomethyl group, a 3'-O-methylamino group, or derivatives thereof may be cleaved with nitrous acid, through a mechanism utilizing nitrous acid, or using a solution comprising nitrous acid. In some embodiments, the chain terminating moiety comprising one or more of a 3'-O-amino group, a 3'-O-aminomethyl group, a 3'-O-methylamino group, or derivatives thereof may be cleaved using a solution comprising nitrite. In some embodiments, for example, nitrite may be combined with or contacted with an acid such as acetic acid, sulfuric acid, or nitric acid. In some embodiments, the chain terminating moiety comprises a 3'-acetal moiety which can be cleaved with a palladium deblocking reagent (e.g., Pd(0)). In some further embodiments, for example, nitrite may be combined with or contacted with an organic acid such as, for example, formic acid, acetic acid, propionic acid, butyric acid, isobutyric acid, or the like.

In some embodiments, in the methods for determining the sequence of one or more nucleic acid template molecules, at least one nucleotide in the plurality of nucleotides of step (g) comprises a chain terminating moiety which is selected from a group consisting of 3'-deoxy nucleotides, 2',3'-dideoxy-nucleotides, 3'-methyl, 3'-azido, 3'-azidomethyl, 3'-O-azidoalkyl, 3'-0-ethynyl, 3'-O-aminoalkyl, 3'-O-fluoroalkyl, 3'-fluoromethyl, 3'-difluoromethyl, 3'-trifluoromethyl, 3'-sulfonyl, 3'-malonyl, 3'-amino, 3'-O-amino, 3'-sulfhydral, 3'-aminomethyl, 3'-ethyl, 3'butyl, 3'-tert butyl, 3'-Fluorenylmethyloxycarbonyl, 3' tert-Butyloxycarbonyl, 3'-O-alkyl hydroxylamino group, 3'-phosphorothioate, 3'-O-benzyl, and 3'-acetal moiety, or derivatives thereof.

In some embodiments, in the methods for determining the sequence of one or more nucleic acid template molecules, at least one nucleotide in the plurality of nucleotides of step (g) comprises detectable reporter moiety (e.g., at least one labeled nucleotide). The detectable reporter moiety comprises a fluorophore. In some embodiments, the fluorophore is attached to the nucleotide base. In some embodiments, the fluorophore is attached to the nucleotide base with a linker which is cleavable/removable from the base. In some embodiments, at least one of the nucleotides in the plurality is not labeled with a detectable reporter moiety. In some embodiments, a particular detectable reporter moiety (e.g., fluorophore) that is attached to the nucleotide can correspond to the nucleotide base (e.g., dATP, dGTP, dCTP, dTTP or dUTP) to permit detection and identification of the nucleotide base.

In some embodiments, in the methods for determining the sequence of one or more nucleic acid template molecules, at least one nucleotide in the plurality of nucleotides of step (g) comprises a cleavable linker on the base which comprises a cleavable (e.g., removable) moiety comprising an alkyl group, alkenyl group, alkynyl group, allyl group, aryl group, benzyl group, azide group, amine group, amide group, keto group, isocyanate group, phosphate group, thio group, disulfide group, carbonate group, urea group, or silyl group. In some embodiments, the cleavable linker on the base is cleavable/removable from the base by reacting the cleavable moiety with a chemical agent, pH change, light or heat. In some embodiments, the cleavable moieties alkyl, alkenyl, alkynyl and allyl are cleavable with tetrakis(triphenylphosphine)palladium(0) (Pd(PPh$_3$)$_4$) with piperidine, or with 2,3-Dichloro-5,6-dicyano-1,4-benzo-quinone (DDQ). In some embodiments, the cleavable moieties aryl and benzyl are cleavable with H2 Pd/C. In some embodiments, the cleavable moieties amine, amide, keto, isocyanate, phosphate, thio, disulfide are cleavable with phosphine or with a thiol group including beta-mercaptoethanol or dithiothritol (DTT). In some embodiments, the cleavable moiety carbonate is cleavable with potassium carbonate (K$_2$CO$_3$) in MeOH, with triethylamine in pyridine, or with Zn in acetic acid (AcOH). In some embodiments, the cleavable moieties urea and silyl are cleavable with tetrabutylammonium fluoride, pyridine-HF, with ammonium fluoride, or with triethylamine trihydrofluoride.

In some embodiments, in the methods for determining the sequence of one or more nucleic acid template molecules, at least one nucleotide in the plurality of nucleotides of step (g) comprises a cleavable linker on the base which comprises cleavable moiety including an azide, azido or azidomethyl group. In some embodiments, the cleavable moieties azide, azido and azidomethyl group are cleavable/removable with a phosphine compound. In some embodiments, the phosphine compound comprises a derivatized tri-alkyl phosphine moiety or a derivatized tri-aryl phosphine moiety. In some embodiments, the phosphine compound comprises Tris(2-carboxyethyl)phosphine (TCEP) or bis-sulfo triphenyl phosphine (BS-TPP) or Tri(hydroxyproyl)phosphine (THPP). In some embodiments, the cleaving agent comprises 4-dimethylaminopyridine (4-DMAP).

In some embodiments, in the methods for determining the sequence of one or more nucleic acid template molecules, at least one nucleotide in the plurality of nucleotides of step (g) comprises a chain terminating moiety on the sugar 2' and/or sugar 3' position. In some embodiments, the chain terminating moiety on the sugar and the cleavable linker on the base have the same or different cleavable moieties. In some embodiments, the chain terminating moiety (e.g., at the sugar 2' and/or sugar 3' position) and the detectable reporter moiety linked to the base are chemically cleavable/removable with the same chemical agent. In some embodiments, the chain terminating moiety (e.g., at the sugar 2' and/or sugar 3' position) and the detectable reporter moiety linked to the base are chemically cleavable/removable with different chemical agents.

In some embodiments, in the methods for sequencing, the binding complex comprises a mutant polymerase, a nucleic acid template molecule duplexed with a primer, and a nucleotide reagent. In some embodiments, in the methods for sequencing which comprises forming a binding complex, where the binding complex comprises (i) a mutant polymerase, a nucleic acid template molecule duplexed with a primer, and a nucleotide, or the binding complex comprises (ii) a mutant polymerase, a nucleic acid template molecule duplexed with a primer, and a nucleotide unit of a multivalent molecule. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. In some embodiments, the binding complex has a persistence time of greater than about 0.1, 0.2, 0.3, 0.4, 0.5, 0.6, 0.7, 0.8, 0.9, 1 or 30 seconds or more than 30 seconds. The binding complex has a persistence time of greater than about 0.1-0.25 seconds, or about 0.25-0.5 seconds, or about 0.5-0.75 seconds, or about 0.75-1 second, or about 1-2 seconds, or about 2-3 seconds, or about 3-4 second, or about 4-5 seconds, or about 5-30 seconds, or more than 30 seconds and/or wherein the method is or may be carried out at a temperature of at or above 15° C., at or above 20° C., at or above 25° C., at or above 35° C., at or above 37° C., at or above 42° C. at or above 55° C. at or above 60° C., or at or above 72° C., or at or above 80° C., or within a range defined by any of the foregoing. In some embodiments, the binding complexes may have a persistence time of less than 1s, greater than 1s, greater than 2s, greater than 3s, greater than 5s, greater than 10s, greater than 15s, greater than 20s, greater than 30s, greater than 60s, greater than 120s, greater than 360s, greater than 3600s, or more, or for a time lying within a range defined by any two or more of these values. The binding complex (e.g., ternary complex) remains stable until subjected to a condition that causes dissociation of interactions between any of the polymerase, template molecule, primer and/or the nucleotide unit or the nucleotide. For example, a dissociating condition comprises contacting the binding complex with any one or any combination of a detergent, EDTA and/or water. In some embodiments, the present disclosure provides said method wherein the binding complex is deposited on, attached to, or hybridized to, a surface showing a contrast to noise ratio in the detecting step of greater than 20. In some embodiments, the present disclosure provides said method wherein the contacting is performed under a condition that stabilizes the binding complex when the nucleotide or nucleotide unit is complementary to a next base of the template nucleic acid, and destabilizes the binding complex when the nucleotide or nucleotide unit is not complementary to the next base of the template nucleic acid.

In some embodiments, in any of the methods for determining the sequence of one or more nucleic acid template molecules, the support comprises a planar or non-planar support. The support can be solid or semi-solid. In some embodiments, the support can be porous, semi-porous or non-porous. In some embodiments, the surface of the support can be coated with one or more compounds to produce a passivated layer on the support. In some embodiments, the passivated layer forms a porous or semi-porous layer. In some embodiments, the nucleic acid primer, template and/or polymerase, can be attached to the passivated layer to immobilize the primer, template and/or polymerase to the support. In some embodiments, the support comprises a low non-specific binding surface that enable improved nucleic acid hybridization and amplification performance on the support. In general, the support may comprise one or more layers of a covalently or non-covalently attached low-binding, chemical modification layers, e.g., silane layers, polymer films, and one or more covalently or non-covalently attached oligonucleotides that can be used for immobilizing a plurality of nucleic acid template molecules to the support (e.g., FIG. 1). In some embodiments, the support can comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacetamidylpentyl)acrylamide-co-acrylamide (PAZAM). In some embodiments, the support comprises a surface coating having at least one hydrophilic polymer coating layer and at least one layer of a plurality of oligonucleotides. The hydrophilic polymer coating layer can comprise polyethylene glycol (PEG). The hydrophilic polymer coating layer can comprise branched PEG having at least 4 branches. In some embodiments, the low non-specific binding coating has a degree of hydrophilicity which can be measured as a water contact angle, where the water contact angle is no more than 45 degrees. In some embodiments, the density of the plurality of first complexed polymerases immobilized to the support or immobilized to the coating on the support is about $10^2$-$10^6$ per $mm^2$, or about $10^6$-$10^9$ per $mm^2$, or about $10^9$-$10^{12}$ per $mm^2$. In some embodiments, the plurality of first complexed polymerases is immobilized to the support or immobilized to the coating on the support at pre-determined sites on the support (or the coating on the support), or immobilized to the coating on the support at random sites on the support (or the coating on the support).

In some embodiments, the support is passivated with a low non-specific binding coating. The surface coatings described herein exhibit very low non-specific binding to reagents typically used for nucleic acid capture, amplification and sequencing workflows, such as dyes, nucleotides, enzymes, and nucleic acid primers. The surface coatings exhibit low background fluorescence signals or high contrast-to-noise (CNR) ratios compared to conventional surface coatings.

The low non-specific binding coating comprises one layer or multiple layers. In some embodiments, the plurality of surface primers are immobilized to the low non-specific binding coating. In some embodiments, at least one surface primer is embedded within the low non-specific binding coating. The low non-specific binding coating enables improved nucleic acid hybridization and amplification performance. In general, the supports comprise a substrate (or support structure), one or more layers of a covalently or non-covalently attached low-binding, chemical modification layers, e.g., silane layers, polymer films, and one or more covalently or non-covalently attached surface primers that can be used for tethering single-stranded nucleic acid library molecules to the support (e.g., FIG. 1). In some embodiments, the formulation of the coating, e.g., the chemical composition of one or more layers, the coupling chemistry used to cross-link the one or more layers to the support and/or to each other, and the total number of layers, may be varied such that non-specific binding of proteins, nucleic acid molecules, and other hybridization and amplification reaction components to the coating is minimized or reduced relative to a comparable monolayer. The formulation of the coating described herein may be varied such that non-specific hybridization on the coating is minimized or reduced relative to a comparable monolayer. The formulation of the coating may be varied such that non-specific amplification on the coating is minimized or reduced relative to a comparable monolayer. The formulation of the coating may be varied such that specific amplification rates and/or yields on the coating are maximized. Amplification levels suitable for detection are achieved in no more than 2, 3, 4, 5, 6, 7, 8, 9, 10, 15, 20, 25, 30, or more than 30 amplification cycles in some cases disclosed herein.

The support structure that comprises the one or more chemically-modified layers, e.g., layers of a low non-specific binding polymer, may be independent or integrated into another structure or assembly. For example, in some embodiments, the support structure may comprise one or more surfaces within an integrated or assembled microfluidic flow cell. The support structure may comprise one or more surfaces within a microplate format, e.g., the bottom surface of the wells in a microplate. In some embodiments, the support structure comprises the interior surface (such as the lumen surface) of a capillary. In some embodiments, the support structure comprises the interior surface (such as the lumen surface) of a capillary etched into a planar chip.

The attachment chemistry used to graft a first chemically-modified layer to the surface of the support will generally be dependent on both the material from which the surface is fabricated and the chemical nature of the layer. In some embodiments, the first layer may be covalently attached to the surface. In some embodiments, the first layer may be non-covalently attached, e.g., adsorbed to the support through non-covalent interactions such as electrostatic interactions, hydrogen bonding, or van der Waals interactions between the support and the molecular components of the first layer. In either case, the support may be treated prior to attachment or deposition of the first layer. Any of a variety of surface preparation techniques known to those of skill in the art may be used to clean or treat the surface. For example, glass or silicon surfaces may be acid-washed using a Piranha solution (a mixture of sulfuric acid ($H_2SO_4$) and hydrogen peroxide ($H_2O_2$)), base treatment in KOH and NaOH, and/or cleaned using an oxygen plasma treatment method.

Silane chemistries constitute non-limiting approaches for covalently modifying the silanol groups on glass or silicon surfaces to attach more reactive functional groups (e.g., amines or carboxyl groups), which may then be used in coupling linker molecules (e.g., linear hydrocarbon molecules of various lengths, such as C6, C12, C18 hydrocarbons, or linear polyethylene glycol (PEG) molecules) or layer molecules (e.g., branched PEG molecules or other polymers) to the surface. Examples of suitable silanes that may be used in creating any of the disclosed low binding coatings include, but are not limited to, (3-Aminopropyl) trimethoxysilane (APTMS), (3-Aminopropyl) triethoxysilane (APTES), any of a variety of PEG-silanes (e.g., comprising molecular weights of 1K, 2K, 5K, 10K, 20K, etc.), amino-PEG silane (i.e., comprising a free amino functional group), maleimide-PEG silane, biotin-PEG silane, and the like.

Any of a variety of molecules known to those of skill in the art including, but not limited to, amino acids, peptides, nucleotides, oligonucleotides, other monomers or polymers, or combinations thereof may be used in creating the one or more chemically-modified layers on the support, where the choice of components used may be varied to alter one or more properties of the layers, e.g., the surface density of functional groups and/or tethered oligonucleotide primers, the hydrophilicity/hydrophobicity of the layers, or the three three-dimensional nature (i.e., "thickness") of the layer. Examples of polymers that may be used to create one or more layers of low non-specific binding material in any of the disclosed coatings include, but are not limited to, polyethylene glycol (PEG) of various molecular weights and branching structures, streptavidin, polyacrylamide, polyester, dextran, poly-lysine, and poly-lysine copolymers, or any combination thereof. Examples of conjugation chemistries that may be used to graft one or more layers of material (e.g. polymer layers) to the surface and/or to cross-link the layers to each other include, but are not limited to, biotin-streptavidin interactions (or variations thereof), his tag—Ni/NTA conjugation chemistries, methoxy ether conjugation chemistries, carboxylate conjugation chemistries, amine conjugation chemistries, NHS esters, maleimides, thiol, epoxy, azide, hydrazide, alkyne, isocyanate, and silane.

The low non-specific binding surface coating may be applied uniformly across the support. Alternatively, the surface coating may be patterned, such that the chemical modification layers are confined to one or more discrete regions of the support. For example, the coating may be patterned using photolithographic techniques to create an ordered array or random pattern of chemically-modified regions on the support. Alternately or in combination, the coating may be patterned using, e.g., contact printing and/or ink-jet printing techniques. In some embodiments, an ordered array or random pattern of chemically-modified regions may comprise at least 1, 5, 10, 20, 30, 40, 50, 60, 70, 80, 90, 100, 200, 300, 400, 500, 600, 700, 800, 900, 1000, 2000, 3000, 4000, 5000, 6000, 7000, 8000, 9000, or 10,000 or more discrete regions.

In some embodiments, the low nonspecific binding coatings comprise hydrophilic polymers that are non-specifically adsorbed or covalently grafted to the support. Typically, passivation is performed utilizing poly(ethylene glycol) (PEG, also known as polyethylene oxide (PEO) or polyoxyethylene) or other hydrophilic polymers with different molecular weights and end groups that are linked to a support using, for example, silane chemistry. The end groups distal from the surface can include, but are not limited to, biotin, methoxy ether, carboxylate, amine, NHS ester, maleimide, and bis-silane. In some embodiments, two or more layers of a hydrophilic polymer, e.g., a linear polymer, branched polymer, or multi-branched polymer, may be deposited on the surface. In some embodiments, two or more layers may be covalently coupled to each other or internally cross-linked to improve the stability of the resulting coating. In some embodiments, surface primers with different nucleotide sequences and/or base modifications (or other biomolecules, e.g., enzymes or antibodies) may be tethered to the resulting layer at various surface densities. In some embodiments, for example, both surface functional group density and surface primer concentration may be varied to attain a desired surface primer density range. Additionally, surface primer density can be controlled by diluting the surface primers with other molecules that carry the same functional group. For example, amine-labeled surface primers can be diluted with amine-labeled polyethylene glycol in a reaction with an NETS-ester coated surface to reduce the final primer density. Surface primers with different lengths of linker between the hybridization region and the surface attachment functional group can also be applied to control surface density. Example of suitable linkers include poly-T and poly-A strands at the 5' end of the primer (e.g., 0 to 20 bases), PEG linkers (e.g., 3 to 20 monomer units), and carbon-chain (e.g., C6, C12, C18, etc.). To measure the primer density, fluorescently-labeled primers may be tethered to the surface and a fluorescence reading then compared with that for a dye solution of known concentration.

In some embodiments, the low nonspecific binding coatings comprise a functionalized polymer coating layer covalently bound at least to a portion of the support via a chemical group on the support, a primer grafted to the functionalized polymer coating, and a water-soluble protective coating on the primer and the functionalized polymer coating. In some embodiments, the functionalized polymer coating comprises a poly(N-(5-azidoacetamidylpentyl)acrylamide-co-acrylamide (PAZAM).

In order to scale primer surface density and add additional dimensionality to hydrophilic or amphoteric coatings, supports comprising multi-layer coatings of PEG and other hydrophilic polymers have been developed. By using hydrophilic and amphoteric surface layering approaches that include, but are not limited to, the polymer/co-polymer materials described below, it is possible to increase primer loading density on the support significantly. Traditional PEG coating approaches use monolayer primer deposition, which have been generally reported for single molecule applications, but do not yield high copy numbers for nucleic acid amplification applications. As described herein "layering" can be accomplished using traditional crosslinking approaches with any compatible polymer or monomer subunits such that a surface comprising two or more highly crosslinked layers can be built sequentially. Examples of suitable polymers include, but are not limited to, streptavidin, poly acrylamide, polyester, dextran, poly-lysine, and copolymers of poly-lysine and PEG. In some embodiments, the different layers may be attached to each other through any of a variety of conjugation reactions including, but not limited to, biotin-streptavidin binding, azide-alkyne click reaction, amine-NETS ester reaction, thiol-maleimide reaction, and ionic interactions between positively charged polymer and negatively charged polymer. In some embodiments, high primer density materials may be constructed in solution and subsequently layered onto the surface in multiple steps.

Examples of materials from which the support structure may be fabricated include, but are not limited to, glass, fused-silica, silicon, a polymer (e.g., polystyrene (PS), macroporous polystyrene (MPPS), polymethylmethacrylate (PMMA), polycarbonate (PC), polypropylene (PP), polyethylene (PE), high density polyethylene (HDPE), cyclic olefin polymers (COP), cyclic olefin copolymers (COC), polyethylene terephthalate (PET)), or any combination thereof. Various compositions of both glass and plastic support structures are contemplated.

The support structure may be rendered in any of a variety of geometries and dimensions known to those of skill in the art, and may comprise any of a variety of materials known to those of skill in the art. For example, the support structure may be locally planar (e.g., comprising a microscope slide or the surface of a microscope slide). Globally, the support structure may be cylindrical (e.g., comprising a capillary or the interior surface of a capillary), spherical (e.g., comprising the outer surface of a non-porous bead), or irregular (e.g., comprising the outer surface of an irregularly-shaped, non-porous bead or particle). In some embodiments, the surface of the support structure used for nucleic acid hybridization and amplification may be a solid, non-porous surface. In some embodiments, the surface of the support structure used for nucleic acid hybridization and amplification may be porous, such that the coatings described herein penetrate the porous surface, and nucleic acid hybridization and amplification reactions performed thereon may occur within the pores.

The support structure that comprises the one or more chemically-modified layers, e.g., layers of a low non-specific binding polymer, may be independent or integrated into another structure or assembly. For example, the support structure may comprise one or more surfaces within an integrated or assembled microfluidic flow cell. The support structure may comprise one or more surfaces within a microplate format, e.g., the bottom surface of the wells in a microplate. In some embodiments, the support structure comprises the interior surface (such as the lumen surface) of a capillary. In some embodiments the support structure comprises the interior surface (such as the lumen surface) of a capillary etched into a planar chip.

As noted, the low non-specific binding supports of the present disclosure exhibit reduced non-specific binding of proteins, nucleic acids, and other components of the hybridization and/or amplification formulation used for solid-phase nucleic acid amplification. The degree of non-specific binding exhibited by a given support surface may be assessed either qualitatively or quantitatively. For example, exposure of the surface to fluorescent dyes (e.g., cyanins such as Cy3, or Cy5, etc., fluoresceins, coumarins, rhodamines, etc. or other dyes disclosed herein), fluorescently-labeled nucleotides, fluorescently-labeled oligonucleotides, and/or fluorescently-labeled proteins (e.g. polymerases) under a standardized set of conditions, followed by a specified rinse protocol and fluorescence imaging may be used as a qualitative tool for comparison of non-specific binding on supports comprising different surface formulations. In some embodiments, exposure of the surface to fluorescent dyes, fluorescently-labeled nucleotides, fluorescently-labeled oligonucleotides, and/or fluorescently-labeled proteins (e.g. polymerases) under a standardized set of conditions, followed by a specified rinse protocol and fluorescence imaging may be used as a quantitative tool for comparison of non-specific binding on supports comprising different surface formulations-provided that care has been taken to ensure that the fluorescence imaging is performed under conditions where fluorescence signal is linearly related (or related in a predictable manner) to the number of fluorophores on the support surface (e.g., under conditions where signal saturation and/or self-quenching of the fluorophore is not an issue) and suitable calibration standards are used. In some embodiments, other techniques known to those of skill in the art, for example, radioisotope labeling and counting methods may be used for quantitative assessment of the degree to which non-specific binding is exhibited by the different support surface formulations of the present disclosure.

Some surfaces disclosed herein exhibit a ratio of specific to nonspecific binding of a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein. Some surfaces disclosed herein exhibit a ratio of specific to nonspecific fluorescence of a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein.

The degree of non-specific binding exhibited by the disclosed low-binding supports may be assessed using a standardized protocol for contacting the surface with a labeled protein (e.g., bovine serum albumin (BSA), streptavidin, a DNA polymerase, a reverse transcriptase, a helicase, a single-stranded binding protein (SSB), etc., or any combination thereof), a labeled nucleotide, a labeled oligonucleotide, etc., under a standardized set of incubation and rinse conditions, followed be detection of the amount of label remaining on the surface and comparison of the signal resulting therefrom to an appropriate calibration standard. In some embodiments, the label may comprise a fluorescent label. In some embodiments, the label may comprise a radioisotope. In some embodiments, the label may comprise any other detectable label known to one of skill in the art. In some embodiments, the degree of non-specific binding exhibited by a given support surface formulation may thus be assessed in terms of the number of non-specifically bound protein molecules (or nucleic acid molecules or other molecules) per unit area. In some embodiments, the low-binding supports of the present disclosure may exhibit non-specific protein binding (or non-specific binding of other specified molecules, (e.g., cyanins such as Cy3, or Cy5, etc., fluoresceins, coumarins, rhodamines, etc. or other dyes disclosed herein)) of less than 0.001 molecule per $\mu m^2$, less than 0.01 molecule per $\mu m^2$, less than 0.1 molecule per $\mu m^2$, less than 0.25 molecule per $\mu m^2$, less than 0.5 molecule per 1 $\mu m^2$, less than 1 molecule per $\mu m^2$, less than 10 molecules per $\mu m^2$, less than 100 molecules per $\mu m^2$, or less than 1,000 molecules per $\mu m^2$. Those of skill in the art will realize that a given support surface of the present disclosure may exhibit non-specific binding falling anywhere within this range, for example, of less than 86 molecules per $\mu m^2$. For example, some modified surfaces disclosed herein exhibit nonspecific protein binding of less than 0.5 molecule/$\mu m^2$ following contact with a 1 $\mu M$ solution of Cy3 labeled streptavidin (GE Amersham) in phosphate buffered saline (PBS) buffer for 15 minutes, followed by 3 rinses with deionized water. Some modified surfaces disclosed herein exhibit nonspecific binding of Cy3 dye molecules of less than 0.25 molecules per 1 $\mu m^2$. In independent nonspecific binding assays, 1 $\mu M$ labeled Cy3 SA (ThermoFisher), 1 $\mu M$ Cy5 SA dye (ThermoFisher), 10 $\mu M$ Aminoallyl-dUTP-ATTO-647N (Jena Biosciences), 10 $\mu M$ Aminoallyl-dUTP-ATTO-Rhol 1 (Jena Biosciences), 10 $\mu M$ Aminoallyl-dUTP-ATTO-Rhol 1 (Jena Biosciences), 10 $\mu M$ 7-Propargylamino-7-deaza-dGTP-Cy5 (Jena Biosciences, and 10 $\mu M$ 7-Propargylamino-7-deaza-dGTP-Cy3 (Jena Biosciences) were incubated on the low binding coated supports at 37° C. for 15 minutes in a 384 well plate format. Each well was rinsed 2-3× with 50 ul deionized RNase/DNase Free water and 2-3× with 25 mM ACES buffer pH 7.4. The 384 well plates were imaged on a GE Typhoon instrument using the Cy3, AF555, or Cy5 filter sets (according to dye test performed) as specified by the manufacturer at a PMT gain setting of 800 and resolution of 50-100 $\mu m$. For higher resolution imaging, images were collected on an Olympus IX83 microscope (e.g., inverted fluorescence microscope) (Olympus Corp., Center Valley, Pa.) with a total internal reflectance fluorescence (TIRF) objective (100×, 1.5 NA, Olympus), a CCD camera (e.g., an Olympus EM-CCD monochrome camera, Olympus XM-10 monochrome camera, or an Olympus DP80 color and monochrome camera), an illumination source (e.g., an Olympus 100W Hg lamp, an Olympus 75W Xe lamp, or an Olympus U-HGLGPS fluorescence light source), and excitation wavelengths of 532 nm or 635 nm. Dichroic mirrors were purchased from Semrock (IDEX Health & Science, LLC, Rochester, N.Y.), e.g., 405, 488, 532, or 633 nm dichroic reflectors/beamsplitters, and band pass filters were chosen as 532 LP or 645 LP concordant with the appropriate excitation wavelength. Some modified surfaces disclosed herein exhibit nonspecific binding of dye molecules of less than 0.25 molecules per $\mu m^2$. In some embodiments, the coated support was immersed in a buffer (e.g., 25 mM ACES, pH 7.4) while the image was acquired.

In some embodiments, the surfaces disclosed herein exhibit a ratio of specific to nonspecific binding of a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein. In some embodiments, the surfaces disclosed herein exhibit a ratio of specific to nonspecific fluorescence signals for a fluorophore such as Cy3 of at least 2, 3, 4, 5, 6, 7, 8, 9, 10, 11, 12, 13, 14, 15, 16, 17, 18, 19, 20, 25, 30, 35, 40, 50, 75, 100, or greater than 100, or any intermediate value spanned by the range herein.

The low-background surfaces consistent with the disclosure herein may exhibit specific dye attachment (e.g., Cy3 attachment) to non-specific dye adsorption (e.g., Cy3 dye adsorption) ratios of at least 4:1, 5:1, 6:1, 7:1, 8:1, 9:1, 10:1, 15:1, 20:1, 30:1, 40:1, 50:1, or more than 50 specific dye molecules attached per molecule nonspecifically adsorbed. Similarly, when subjected to an excitation energy, low-background surfaces consistent with the disclosure herein to which fluorophores, e.g., Cy3, have been attached may exhibit ratios of specific fluorescence signal (e.g., arising from Cy3-labeled oligonucleotides attached to the surface) to non-specific adsorbed dye fluorescence signals of at least 4:1, 5:1, 6:1, 7:1, 8:1, 9:1, 10:1, 15:1, 20:1, 30:1, 40:1, 50:1, or more than 50:1.

In some embodiments, the degree of hydrophilicity (or "wettability" with aqueous solutions) of the disclosed support surfaces may be assessed, for example, through the measurement of water contact angles in which a small droplet of water is placed on the surface and its angle of contact with the surface is measured using, e.g., an optical tensiometer. In some embodiments, a static contact angle may be determined. In some embodiments, an advancing or receding contact angle may be determined. In some embodiments, the water contact angle for the hydrophilic, low-binding support surfaced disclosed herein may range from about 0 degrees to about 30 degrees. In some embodiments, the water contact angle for the hydrophilic, low-binding support surfaced disclosed herein may no more than 50 degrees, 40 degrees, 30 degrees, 25 degrees, 20 degrees, 18 degrees, 16 degrees, 14 degrees, 12 degrees, 10 degrees, 8 degrees, 6 degrees, 4 degrees, 2 degrees, or 1 degree. In many cases the contact angle is no more than 40 degrees. Those of skill in the art will realize that a given hydrophilic, low-binding support surface of the present disclosure may exhibit a water contact angle having a value of anywhere within this range.

In some embodiments, the hydrophilic surfaces disclosed herein facilitate reduced wash times for bioassays, often due to reduced nonspecific binding of biomolecules to the low-binding surfaces. In some embodiments, adequate wash steps may be performed in less than 60, 50, 40, 30, 20, 15, 10, or less than 10 seconds. For example, adequate wash steps may be performed in less than 30 seconds.

Some low-binding surfaces of the present disclosure exhibit significant improvement in stability or durability to prolonged exposure to solvents and elevated temperatures, or to repeated cycles of solvent exposure or changes in temperature. For example, the stability of the disclosed surfaces may be tested by fluorescently labeling a functional group on the surface, or a tethered biomolecule (e.g., an oligonucleotide primer) on the surface, and monitoring fluorescence signal before, during, and after prolonged exposure to solvents and elevated temperatures, or to repeated cycles of solvent exposure or changes in temperature. In some embodiments, the degree of change in the fluorescence used to assess the quality of the surface may be less than 1%, 2%, 3%, 4%, 5%, 10%, 15%, 20%, or 25% over a time period of 1 minute, 2 minutes, 3 minutes, 4 minutes, 5 minutes, 10 minutes, 20 minutes, 30 minutes, 40 minutes, 50 minutes, 60 minutes, 2 hours, 3 hours, 4 hours, 5 hours, 6 hours, 7 hours, 8 hours, 9 hours, 10 hours, 15 hours, 20 hours, 25 hours, 30 hours, 35 hours, 40 hours, 45 hours, 50 hours, or 100 hours of exposure to solvents and/or elevated temperatures (or any combination of these percentages as measured over these time periods). In some embodiments, the degree of change in the fluorescence used to assess the quality of the surface may be less than 1%, 2%, 3%, 4%, 5%, 10%, 15%, 20%, or 25% over 5 cycles, 10 cycles, 20 cycles, 30 cycles, 40 cycles, 50 cycles, 60 cycles, 70 cycles, 80 cycles, 90 cycles, 100 cycles, 200 cycles, 300 cycles, 400 cycles, 500 cycles, 600 cycles, 700 cycles, 800 cycles, 900 cycles, or 1,000 cycles of repeated exposure to solvent changes and/or changes in temperature (or any combination of these percentages as measured over this range of cycles).

In some embodiments, the surfaces disclosed herein may exhibit a high ratio of specific signal to nonspecific signal or other background. For example, when used for nucleic acid amplification, some surfaces may exhibit an amplification signal that is at least 4, 5, 6, 7, 8, 9, 10, 15, 20, 30, 40, 50, 75, 100, or greater than 100 fold greater than a signal of an adjacent unpopulated region of the surface. Similarly, some surfaces exhibit an amplification signal that is at least 4, 5, 6, 7, 8, 9, 10, 15, 20, 30, 40, 50, 75, 100, or greater than 100 fold greater than a signal of an adjacent amplified nucleic acid population region of the surface.

In some embodiments, fluorescence images of the disclosed low background surfaces when used in nucleic acid hybridization or amplification applications to create polonies of hybridized or clonally-amplified nucleic acid molecules (e.g., that have been directly or indirectly labeled with a fluorophore) exhibit contrast-to-noise ratios (CNRs) of at least 10, 20, 30, 40, 50, 60, 70, 80, 90, 100, 110, 120, 130, 140, 150, 160, 170, 180, 190, 20, 210, 220, 230, 240, 250, or greater than 250.

One or more types of primer may be attached or tethered to the support surface. In some embodiments, the one or more types of adapters or primers may comprise spacer sequences, adapter sequences for hybridization to adapter-ligated target library nucleic acid sequences, forward amplification primers, reverse amplification primers, sequencing primers, and/or molecular barcoding sequences, or any combination thereof. In some embodiments, 1 primer or adapter sequence may be tethered to at least one layer of the surface. In some embodiments, at least 2, 3, 4, 5, 6, 7, 8, 9, 10, or more than 10 different primer or adapter sequences may be tethered to at least one layer of the surface.

In some embodiments, the tethered adapter and/or primer sequences may range in length from about 10 nucleotides to about 100 nucleotides. In some embodiments, the tethered adapter and/or primer sequences may be at least 10, at least 20, at least 30, at least 40, at least 50, at least 60, at least 70, at least 80, at least 90, or at least 100 nucleotides in length. In some embodiments, the tethered adapter and/or primer sequences may be at most 100, at most 90, at most 80, at most 70, at most 60, at most 50, at most 40, at most 30, at most 20, or at most 10 nucleotides in length. Any of the lower and upper values described in this paragraph may be combined to form a range included within the present disclosure, for example, in some embodiments the length of the tethered adapter and/or primer sequences may range from about 20 nucleotides to about 80 nucleotides. Those of skill in the art will recognize that the length of the tethered adapter and/or primer sequences may have any value within this range, e.g., about 24 nucleotides.

In some embodiments, the resultant surface density of primers (e.g., capture primers) on the low binding support surfaces of the present disclosure may range from about 100 primer molecules per $\mu m^2$ to about 100,000 primer molecules per $\mu m^2$. In some embodiments, the resultant surface density of primers on the low binding support surfaces of the present disclosure may range from about 1,000 primer molecules per $\mu m^2$ to about 1,000,000 primer molecules per $\mu m^2$. In some embodiments, the surface density of primers may be at least 1,000, at least 10,000, at least 100,000, or at least 1,000,000 molecules per $\mu m^2$. In some embodiments, the surface density of primers may be at most 1,000,000, at most 100,000, at most 10,000, or at most 1,000 molecules per $\mu m^2$. Any of the lower and upper values described in this paragraph may be combined to form a range included within the present disclosure, for example, in some embodiments the surface density of primers may range from about 10,000 molecules per $\mu m^2$ to about 100,000 molecules per $\mu m^2$. Those of skill in the art will recognize that the surface density of primer molecules may have any value within this range, e.g., about 455,000 molecules per $\mu m2$. In some embodiments, the surface density of target library nucleic acid sequences initially hybridized to adapter or primer sequences on the support surface may be less than or equal to that indicated for the surface density of tethered primers. In some embodiments, the surface density of clonally-amplified target library nucleic acid sequences hybridized to adapter or primer sequences on the support surface may span the same range as that indicated for the surface density of tethered primers.

Local densities as listed above do not preclude variation in density across a surface, such that a surface may comprise a region having an oligo density of, for example, 500,000/$\mu m^2$, while also comprising at least a second region having a substantially different local density.

In some embodiments, the performance of nucleic acid hybridization and/or amplification reactions using the disclosed reaction formulations and low-binding supports may be assessed using fluorescence imaging techniques, where the contrast-to-noise ratio (CNR) of the images provides a key metric in assessing amplification specificity and non-specific binding on the support. CNR is commonly defined as: CNR=(Signal-Background)/Noise. The background term is commonly taken to be the signal measured for the interstitial regions surrounding a particular feature (diffraction limited spot, DLS) in a specified region of interest (ROI). While signal-to-noise ratio (SNR) is often considered to be a benchmark of overall signal quality, it can be shown that improved CNR can provide a significant advantage over SNR as a benchmark for signal quality in applications that require rapid image capture (e.g., sequencing applications for which cycle times must be minimized), as shown in the example below. At high CNR the imaging time required to reach accurate discrimination (and thus accurate base-calling in the case of sequencing applications) can be drastically reduced even with moderate improvements in CNR. Improved CNR in imaging data on the imaging integration time provides a method for more accurately detecting features such as clonally-amplified nucleic acid colonies on the support surface.

In most ensemble-based sequencing approaches, the background term is typically measured as the signal associated with 'interstitial' regions. In addition to "interstitial" background ($B_{inter}$, "intrastitial" background ($B_{intra}$) exists within the region occupied by an amplified DNA colony. The combination of these two background signals dictates the achievable CNR, and subsequently directly impacts the optical instrument requirements, architecture costs, reagent costs, run-times, cost/genome, and ultimately the accuracy and data quality for cyclic array-based sequencing applications. The $B_{inter}$ background signal arises from a variety of sources; a few examples include auto-fluorescence from consumable flow cells, non-specific adsorption of detection molecules that yield spurious fluorescence signals that may obscure the signal from the ROI, the presence of non-specific DNA amplification products (e.g., those arising from primer dimers). In typical next generation sequencing (NGS) applications, this background signal in the current field-of-view (FOV) is averaged over time and subtracted. The signal arising from individual DNA colonies (i.e., (Signal)-B(interstial) in the FOV) yields a discernable feature that can be classified. In some embodiments, the intrastitial background (B(intrastitial)) can contribute a confounding fluorescence signal that is not specific to the target of interest, but is present in the same ROI thus making it far more difficult to average and subtract.

Nucleic acid amplification on the low-binding coated supports described herein may decrease the B(interstitial) background signal by reducing non-specific binding, may lead to improvements in specific nucleic acid amplification, and may lead to a decrease in non-specific amplification that can impact the background signal arising from both the interstitial and intrastitial regions. In some embodiments, the disclosed low-binding coated supports, optionally used in combination with the disclosed hybridization and/or amplification reaction formulations, may lead to improvements in CNR by a factor of 2, 5, 10, 100, 250, 500 or 1000-fold over those achieved using conventional supports and hybridization, amplification, and/or sequencing protocols. Although described here in the context of using fluorescence imaging as the read-out or detection mode, the same principles apply to the use of the disclosed low-binding coated supports and nucleic acid hybridization and amplification formulations for other detection modes as well, including both optical and non-optical detection modes.

The present disclosure provides methods for determining the sequence of a nucleic acid template molecule, where the multivalent molecules are labeled with fluorophores and the detecting and/or identifying steps comprise use of fluorescence imaging. In some embodiments, the fluorescence imaging comprises dual wavelength excitation/four wavelength emission fluorescence imaging. In some embodiments, four different types of multivalent molecules are employed, each comprising a different nucleotide unit (or nucleotide unit analog). For example, a first type of multivalent molecules comprise dATP nucleotide units, a second type of multivalent molecules comprise dGTP nucleotide units, a third type of multivalent molecules comprise dCTP nucleotide units, and a fourth type of multivalent molecules comprise dTTP nucleotide units. In some embodiments, the four different types of multivalent molecules are labeled with a different fluorophore that corresponds to the nucleotide units attached to a given multivalent molecule to permit identification of the nucleotide units. In some embodiments, the detecting step comprises simultaneous or single excitation at a wavelength sufficient to excite all four fluorophores and imaging of fluorescence emission at wavelengths sufficient to detect each respective fluorophore. In some embodiments, the four labeled multivalent molecules are used to determine the identity of a terminal nucleotide in the nucleic acid template molecule. In some embodiments, the four types of multivalent molecules are labeled with different fluorophores, including for example fluorophores that emit different visible colors such as blue, green, yellow, orange or red. In some embodiments, the four types of multivalent molecules are labeled with different fluorophores, including for example Cy2 or a dye or fluorophore similar in excitation or emission properties, Cy3 or a dye or fluorophore similar in excitation or emission properties, Cy3.5 or a dye or fluorophore similar in excitation or emission properties, Cy5 or a dye or fluorophore similar in excitation or emission properties, Cy5.5 or a dye or fluorophore similar in excitation or emission properties, and Cy7 or a dye or fluorophore similar in excitation or emission properties. In some embodiments, the detecting step comprises simultaneous excitation at any two of 532 nm, 568 nm and 633 nm, and imaging of fluorescence emission at about 570 nm, 592 nm, 670 nm, and 702 nm, respectively. In some embodiments, the fluorescence imaging comprises dual wavelength excitation/dual wavelength emission fluorescence imaging. In some embodiments, the four different types of multivalent molecules are labeled with distinguishable fluorophores (or a set of fluorophores), and the detecting step comprises simultaneous or single excitation at a wavelength sufficient to excite one, two, three, or four fluorophores or sets of fluorophores, and imaging of fluorescence emission at wavelengths is sufficient to detect each respective fluorophore.

In some embodiments, the sequencing methods can be conducted with three different types of labeled multivalent molecules and one type of unlabeled multivalent molecule (e.g., a "dark" multivalent molecule), where the labeled multivalent molecules are labeled with a different fluorophore that corresponds to the nucleotide units attached to a given multivalent molecule to permit identification of the nucleotide units. In some embodiments, the detecting step comprises simultaneous excitation at a wavelength sufficient to excite the three types of fluorophores and imaging of fluorescence emission at wavelengths is sufficient to detect each respective fluorophore, and detection of the fourth type of multivalent molecule is determined or determinable with reference to the location of "dark" or unlabeled spots.

In some embodiments, the fluorophores comprise a FRET donor and accepter pair, such that multiple detections and identifications can be performed under a single excitation and imaging step. In some embodiments, a sequencing cycle comprises forming a plurality of complexed polymerases, contacting the complexed polymerases with a plurality of different types of fluorescently-labeled multivalent molecules, and detecting the fluorescently-labeled multivalent molecules that are bound to the complexed polymerases. In some embodiments, a sequencing cycle can be conducted in less than 30 minutes, in less than 20 minutes, or in less than 10 minutes. In some embodiments, conducting sequencing reactions with labeled multivalent molecules gives an average Q-score for base calling accuracy over a sequencing run which is greater than or equal to 30, and/or greater than or equal to 40. In some embodiments, at least 50%, at least 60%, at least 70%, at least 80%, or at least 90% of the base calls have a Q-score of greater than 30 and/or greater than or equal to 40. In some embodiments, the present disclosure provides the method, herein at least 95% of the base calls have a Q-score of greater than 30.

EXAMPLES

The following examples are meant to be illustrative and can be used to further understand embodiments of the present disclosure and should not be construed as limiting the scope of the present teachings in any way.

EXAMPLE 1: Clarified Lysate Preparation of Mutant Polymerases

Mutant polymerases were prepared using site directed mutagenesis. The mutated sites of the mutant polymerases are listed in Table 1 (FIGS. 29A-29Q), Table 4 (FIGS. 32A-32G), Table 6 (FIGS. 34A-34NN), Table 8 (FIGS. 36A-36F) and Table 11 (FIGS. 39A-39B).

Host cells harboring an expression vector operably linked to a nucleic acid encoding a wild type polymerase or one of the mutant polymerases were prepared. The host cells were cultured under conditions suitable for expressing the wild type or mutant polymerase. The host cells were grown in plate format and centrifuged after expression. Cell pellets were lysed by treatment with lysozyme in buffer (20 mM Tris-HCl (pH 8.8), 10 mM KCl, 10 mM $(NH_4)_2SO_4$)) and centrifuged again. The supernatants were transferred to PCR plates and heat shocked at 65° C. for 60 minutes. The heat shocked lysates were then clarified by centrifuge and the supernatants transferred to a new plate for the nucleotide incorporation assay.

EXAMPLE 2: Nucleotide Incorporation Assay

Atto dye-labeled DNA templates were used to prepare the DNA duplexes. The labeled DNA templates were annealed with primers in a reaction buffer (Tris-HCl (pH 7.5), NaCl, EDTA). The duplexes were mixed with the clarified lysates (described in Example 1) and allowed to equilibrate to 42° C. The nucleotide incorporation reaction was started with the addition of a 3' methylazido nucleotide corresponding to the next base on the template (e.g., dCTP-N3). The reaction was allowed to proceed under different temperature and time conditions, for example 42° C. for 150 seconds, or 56° C. for as little as 2 seconds, and quenched with EDTA and formamide. The analysis of the n+1 vs n was performed by capillary electrophoresis.

The incorporation data listed in Table 1 (FIGS. 29A-29Q), Table 4 (FIGS. 32A-32G), Table 7 (FIG. 35), Table 9 (FIG. 37), Table 11 (FIGS. 39A-39B) and Table 12 (FIG. 40) represent the relative activity of mutant polymerases compared to wild type enzyme in incorporation of 3'methylazido nucleotides at the N+1 position of an extending polynucleotide chain at 42° C.

Numerous mutant polymerases were expressed by recombinant host cells as described in Example 1. Lysates from the expression host cells, which contained mutant polymerases, were subjected to heat shock at 65° C. for 60 minutes. The mutant polymerases in the heat shocked lysates were screened for their ability to incorporate a 3' methylazido nucleotide as described in Example 2. Analysis of the incorporation reactions were conducted via capillary electrophoresis as described in Example 2. The incorporation activities of the mutant polymerases were assigned a grade of 0 if they exhibited zero or negligible incorporation activity, or assigned a grade of +or ++if they exhibited moderate or high incorporation activity respectively. It was predicted that approximately 50-60% or more of the mutant polymerases would exhibit incorporation activity having a grade of +or higher.

EXAMPLE 3: Thermal Melt Assays

Purified wild type and mutant polymerases in a heparin elution buffer was mixed with 1X SYPRO Orange Protein Gel Stain and run on a CFX384 thermocycler. The thermal melt data was analyzed using a CFX Maestro software (from Bio-Rad). Thermal melt data (Tm) for wild type and mutant polymerases having backbone sequences RLF 89458.1, RLF 60390.1, NOZ 58130 or WP 175059460.1 were conducted.

EXAMPLE 4: Uracil Incorporation Assays

Primed DNA template molecules in a reaction buffer was mixed with a purified mutant polymerase and allowed to equilibrate to 42° C. The reaction was started by adding a 3' methylazido nucleotide corresponding to the next base on the template molecule. The reaction was allowed to proceed at 42° C. and quenched with EDTA and formamide at incremental time points. Analysis of the n+1 versus n was performed by capillary electrophoresis. The incorporation rates of dATP nucleotide analog into a template having a thymine as the next base in the template molecule was assayed. The incorporation rates of dATP nucleotide analog into a template having an adenine as the next base in the template molecule was assayed. The incorporation rates of dATP nucleotide analog into a template having a uracil as the next base in the template molecule was assayed. Some of the mutant polymerases exhibited increased capability for incorporating a dATP nucleotide analog into a uracil-containing template molecule.

EXAMPLE 5: Assay for Binding Labeled Multivalent Molecules

DNA concatemers were prepared and immobilized to flowcells. A solution of fluorescently-labeled multivalent molecules (e.g., see FIG. 5) and engineered polymerase enzyme was flowed onto the flowcells. Each solution contained multivalent molecules carrying nucleotide units of dATP, dGTP, dCTP or dTTP. The core of the multivalent molecules were labeled with different fluorophores that correspond to the nucleotide units of dATP, dGTP, dCTP or dTTP. The concatemers were reacted with the solution for 10 seconds, then removed using air. The multivalent molecules and polymerase enzyme was removed with a wash buffer. An imaging solution was flowed onto the flowcell and the fluorescent intensity of the multivalent molecules bound to the concatemers was measured. The purity of the bound nucleotide unit was calculated by dividing the fluorescent intensity of the dominant nucleotide unit (e.g., the correct nucleotide unit) by the sum of the intensities of all four nucleotide units. The multivalent binding data is listed in Table 2 (FIGS. 30-1 through 30-26) and Table 5 (FIG. 33). The intensity exhibited by the mutant polymerases were assigned a grade of 0 if they exhibited zero or negligible activity, or assigned a grade of +or ++if they exhibited moderate or high activity respectively. It was predicted that approximately 50-60% or more of the mutant polymerases would exhibit intensity having a grade of +or higher.

In a separate assay, complexed engineered polymerases were reacted with fluorescently labeled multivalent molecules carrying nucleotide units of dATP, dGTP, dCTP or dUTP, under different temperature and time conditions. For example, the temperature tested included 25-56° C., and the time during included 1— 90 seconds. Images and intensities of multivalent molecules binding the complexed polymerases were acquired.

EXAMPLE 6: Sequencing Using Multivalent Molecules and Nucleotides

A two-stage sequencing reaction was conducted on a flow cell having a plurality of concatemer template molecules immobilized thereon (e.g., immobilized polonies).

The first-stage sequencing reaction was conducted by hybridizing a plurality of a soluble sequencing primers to concatemer template molecules that were immobilized to a flow cells to form immobilized primer-concatemer duplexes. A plurality of a first sequencing polymerase was flowed onto the flow cell (e.g., contacting the immobilized primer-concatemer duplexes) and incubated under a condition suitable to bind the sequencing polymerase to the duplexes to form complexed polymerases. Exemplary first sequencing polymerases comprise an amino acid backbone sequence of any one of SEQ ID NOS: 3-1315, 1317-2214, 2216-2366, 2368-2392, 2394-2407, 2409-2435, 2437-2454, 2456-2501 or 2511-2523. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. A mixture of fluorescently labeled multivalent molecules (e.g., at different concentrations of about 20-100 nM) was flowed onto the flow cell in the presence of a buffer that included a non-catalytic cation (e.g., strontium, barium and/or calcium) and incubated under conditions suitable to bind complementary nucleotide units of the multivalent molecules to the complexed polymerases to form avidity complexes without polymerase-catalyzed incorporation of the nucleotide units. Various temperature and time conditions were tested, for example 25-56° C. for 5-90 seconds. The fluorescently labeled multivalent molecules were labeled at their cores. The complexed polymerases were washed. An image was obtained of the fluorescently labeled multivalent molecules that remined bound to the complexed polymerases. The first sequencing polymerases and multivalent molecules were removed, while retaining the sequencing primers hybridized to the immobilized concatemers (retained duplexes), by washing with a buffer comprising a detergent.

The first stage sequencing reaction was suitable for forming a plurality of avidity complexes on the concatemer template molecules (e.g., polonies). For example, the first stage sequencing reaction comprised: (a) binding a first nucleic acid primer, a first polymerase, and a first multivalent molecule to a first portion of a concatemer template molecule thereby forming a first binding complex, wherein a first nucleotide unit of the first multivalent molecule was bound to the first polymerase; and (b) binding a second nucleic acid primer, a second polymerase, and the first multivalent molecule to a second portion of the same concatemer template molecule thereby forming a second binding complex, wherein a second nucleotide unit of the first multivalent molecule was bound to the second polymerase, wherein the first and second binding complexes which included the same multivalent molecule formed a first avidity complex.

The second-stage sequencing reaction was conducted by contacting the retained duplexes with a plurality of second sequencing polymerases to form complexed polymerases. Exemplary second sequencing polymerases comprise an amino acid backbone sequence of any one of SEQ ID NOS: 3-1315, 1317-2214, 2216-2366, 2368-2392, 2394-2407, 2409-2435, 2437-2454, 2456-2501 or 2511-2523. In some embodiments, the mutant polymerase comprises an amino acid sequence that is at least 80%, 85%, 90%, 95%, 99% identical, or a higher level sequence identity, to any of SEQ ID NOS: 3-1315, 1317-2214, 2216-2366, 2368-2392, 2394-2407, 2409-2435, 2437-2454, 2456-2501 or 2511-2523. A mixture of non-labeled nucleotide analogs (e.g., 3'O-methylazido nucleotides) (e.g., at different concentrations of about 1-5 uM) was added to the complexed polymerases in the presence of a buffer that included a catalytic cation (e.g., magnesium and/or manganese) and incubated under conditions suitable to bind complementary nucleotides to the complexed polymerases and promote polymerase-catalyzed incorporation of the nucleotides to generate a nascent extended sequencing primer. Various temperature and time conditions were tested, for example 25-56° C. for 5-180 seconds. The complexed polymerases were washed. No image was obtained. The incorporated non-labeled nucleotide analogs were reacted with a cleaving reagent that removes the 3' O-methylazido group and generates an extendible 3'OH group.

In an alternative second stage sequencing reaction, a mixture of fluorescently labeled nucleotide analogs (e.g., 3'O-methylazido nucleotides) (e.g., about 1-5 uM) was added to the complexed polymerases in the presence of a buffer that included a catalytic cation (e.g., magnesium and/or manganese) and incubated under conditions suitable to bind complementary nucleotides to the complexed polymerases and promote polymerase-catalyzed incorporation of the nucleotides to generate a nascent extended sequencing primer. The complexed polymerases were washed. An image was obtained of the incorporated fluorescently labeled nucleotide analogs as a part of the complexed polymerases. The incorporated fluorescently labeled nucleotide analogs were reacted with a cleaving reagent that removes the 3' O-methylazido group and generates an extendible 3'OH group.

Figure 60:
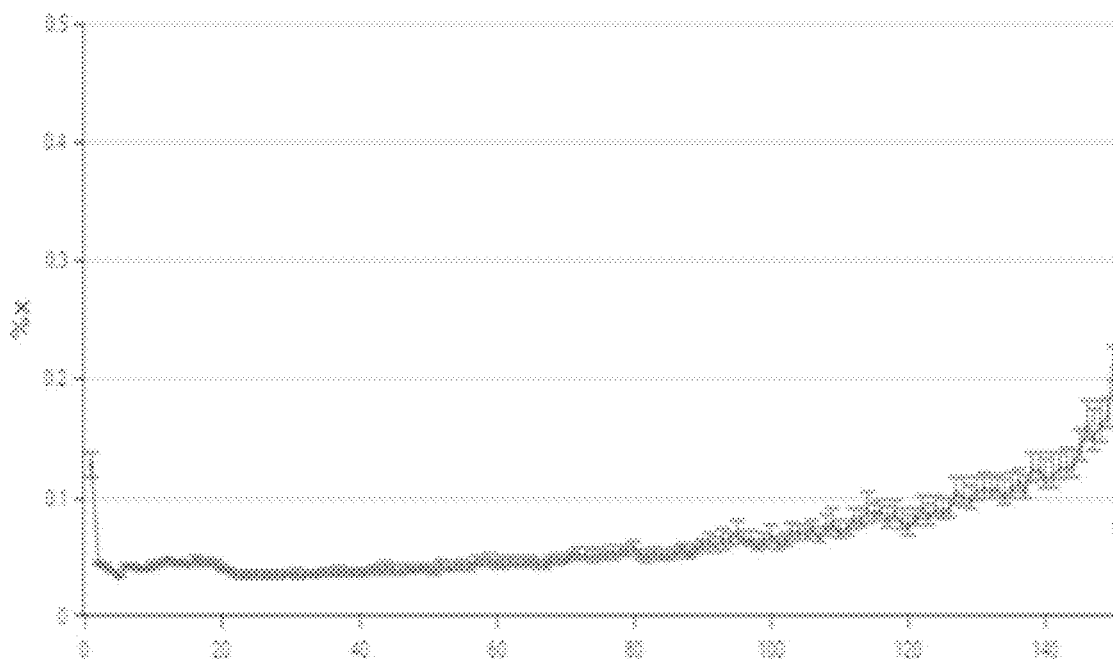
FIG. 60 is a graph showing the % error for a 150 cycle sequencing run of a nucleic acid library prepared from PhiX.

The second sequencing polymerases were removed, while retaining the nascent extended sequencing primers hybridized to the concatemers (retained duplexes), by washing with a buffer comprising a detergent. Recurring sequencing reactions were conducted by performing multiple cycles of first-stage and second-stage sequencing reactions to generate extended forward sequencing primer strands. FIG. 60 shows a 150 cycle sequencing run of a nucleic library prepared from PhiX. The X-axis indicates the sequencing cycle number and the Y-axis indicates the % error.

SEQUENCE LISTING (2524 sequences)

SEQ ID NO: 1 - protein, 773 aa, unidentified
  REGION 1..773: note = Description of Unknown: Thermococci archaeon sequence
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFDIETFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 2 - protein, 773 aa, unidentified
  REGION 1..773: note = Description of Unknown: Thermococci archaeon sequence
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFDIETFYHEGDEFAEGEILMISYADESGAKVITWKKIDLPYVEVVSTEREAIKRFLQVLREKDPDVLLTYNGDNFDFAYIKKRCEKLGLKFTIGREGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 3 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 4 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 5 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 6 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESVEDIRKITGERHGKKVRIIRVEKVKKKFLDEPIEVWKLAFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 7 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATSPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 8 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRVVRVEKVKKKFLGEPIEVWKLVFEHPQDVPAKRDAIRSHPAVREIFGYDIPFAKRYLIDKGLVPMVGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 9 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 10 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDKKKITGERHGMKVRIIRVEKVKKKFLGESIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 11 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIRFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 12 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITDERHGKKVRIIRVEIVKKKFLGEPIEVWKLVFEHPQDVPAIRDAIRSHPAVREIFEYDIPFAKCYLIDKGLVPMEGGEEPKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 13 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 14 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKNFLKHINEKLPSILELEYEGFYLRDFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 15 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLTNYRVPVEKLIIHEQITRELKDYKATGPHVAIAKRLQARGIKVKPGTIISYVVLKGSKKISDRVILFDEYYSSRHKYDPDYYIHNQVLPAVLRILEAFGYKEKDLEYQRMKQTGLGAWLKMGKK

SEQ ID NO: 16 - protein, 773 aa, synthetic construct
  REGION 1..773: note = Description of Artificial Sequence: Synthetic polypeptide
MILDTDYITENGKPVIRIFKKEKGEFKIVYDRNFEPYIYALLEDDESIEDIKKITGERHGKKVRIICVEKVKKKFLGEPIEVWKLVFEHPQDVSAIRDAIRSHPAVREIFEYGIPFAKRYLIDKGLVPMEGGEELKLLAFAFATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 17 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVFLFDEYDSSRHKYDPDYYIHNQVLPAVLRILEAFGYKEKDLEFQRMKQTGLGAWLKMGKK

SEQ ID NO: 18 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANHRMPVEKLIIHEQITRELKGYKATGPHVAIAKRLQARGIKVKPGTIISYVVLKGSKKISDRVILFNEYDSSRHKYDPDYYIHNQVLPAVLRILEAFGYKEKELEYQRMKQTGLGAWLKMGKK

SEQ ID NO: 19 - protein, 773 aa, synthetic construct
  REGION 1..773: note = Description of Artificial Sequence: Synthetic polypeptide
MILDTDYITENGKPVIRIFKKEKGEFKIEYDRNFKPYIYALLEDDESIEDIKKITGERHGKKVRIIRVEKVKEKFLGEPIEVWKLVFEHPQVVPAIRDAIHSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 20 - protein, 773 aa, synthetic construct
  REGION 1..773: note = Description of Artificial Sequence: Synthetic polypeptide
MILDTDYITENGKPVIRIFKKEKGEFKIEYDRNIEPYIYALLEDDESIEDIKKITGERHGKKVRIIRVEKVKKKFLGEPIEVWKLVFEHPRDVPAIHDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 21 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 22 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 23 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDMPAIRDAIRSHPAVREIFEYDIPFAKRYLIDKGLVPMESGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 24 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 25 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVFAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 26 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEMAAGIVKKVAEDLANYRVPVEKLIIHEQITRELKDYKATGPHVAIAKRLQARGIKVKPGTIISYVVLKGSKKISDRVILFDEYVSSRHKYDPDYYIHNQVLPAVLRILEALGYKEKVLEYQRMKQTGLGAWLKMGKK

SEQ ID NO: 27 - protein, 773 aa, synthetic construct
  REGION 1..773: note = Description of Artificial Sequence: Synthetic polypeptide
MILDTDAITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 28 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 29 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRNIRVEKVKKKFLGEPIEVWKLVCEHPQDVSAIRDTIRSHPAVREIFEYDIPFAKRYLIDKGLVPLEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 30 - protein, 773 aa, synthetic construct
  REGION 1..773: note = Description of Artificial Sequence: Synthetic polypeptide
MILDTDYITENGKPVIRIFKKGKGEFKIEYDRNFEPYIYALLEDDESIEDIKKTTGERHGKKARIIRVEKVKKKFLGEPIEVWKLVFEHPQNVPAIRDAIRSHPAVREIFEYDIPFAKRYLIDNGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 31 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGECHGKKVRIIRMEKVKKKFLGEPIEVWKLVFEHLQDVPAIRDTIRSHPAVREIFEYDIPFAKRYLIDKGLVPMEGGEELRLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 32 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 33 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 34 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPSIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 35 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGGPIEVWKLVFEHPQDVPAIRDAIRSHPAVRENFVYDIPFAKRYLINKGLVPMVGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 36 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRNSTGNLVEWYLLRVAYERNELAPNKPSGEEYQRRMRSSYIGGYVKEPEKGLWESIAYQDFRSSAGSIIVTHNVSPDTQEKECKNYDVAPIVGYRFCKDFKGIIPSILEDLIETRQKMKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 37 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 38 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 39 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEDPQDVPATRDAIRSHPAVREIFEYDIPFAKRYLIDKGLVPMEGGEELKFLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 40 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIIKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 41 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYNETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 42 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRAFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 43 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPKVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 44 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 45 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYRRRMRSSYIGGYVKEPEKGLWESIAYLDYRSSAGSIIVTHNVSPDILEKECKNYDVAPIVGYRFCKDFKGFIPSILEDLIETRQKVKRKMKATIDPIEKKMLDYRQRTLKILANSYYGYHGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 46 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIRTHNVSPDTLEKECKNYDVDPIVGYRFCKDFKGFIPSILEDLIETRQKVKRKMKATIDPIEKKMLDYRQRSLKILANSYYGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 47 - protein, 773 aa, synthetic construct
  REGION 1..773: note = Description of Artificial Sequence: Synthetic polypeptide
MILDTDYITENEKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 48 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPRVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 49 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 50 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 51 - protein, 773 aa, synthetic construct
  REGION 1..773: note = Description of Artificial Sequence: Synthetic polypeptide
MILDTDYITDNSKPVIRIFKKVKSEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIEKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 52 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 53 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKFSDRVILFDEYDSSRHEYDPDYYIHNQVLPAVLRILEAFGYKEKDLEYQRMKQTGLGAWLKMGKK

SEQ ID NO: 54 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 55 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKESAESVTAWGRHYIETTIKEAEKFGFKVLYADTDGFFATIPNEKPETIKCKAKKFLKHINEKLPGMLELEYEGFYLRGFFVTKKKYALTDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 56 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 57 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRAAYERNELAPNKPGGEEYQRRMRSSYIGGYVKEPGKGLWESIAYLDFRSSAGSIIVTHNVSSDTLEKECKNYDVAPIVGYRFCRDFKGFIPSILEDLIETRQKVKRKMKATIDPIEKKMLDYRQRALKILANSYYGYHGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 58 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYPLHVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 59 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 60 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVMPGTIISYVVLKGSKMISDRVILFDEYDSSRHKYDPDYYIHNQVLPAVLRILEAFGYKEKDLEYQRMKQTGLGAWLKMGKK

SEQ ID NO: 61 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 62 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNEPAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 63 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 64 - protein, 773 aa, synthetic construct
  REGION 1..773: note = Description of Artificial Sequence: Synthetic polypeptide
MILDTDYITENSKPVIRIFKKEKGEFKIEYDCNFEPYIYALQENDESIEDIKKITGGRHGKKVRINRVEKVKKKFLGEPIEVWKLVFEHPQDVPAICVAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 65 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDFKEIIGKRHGKKVRIIRVEKVKKKFQGEPIEVWKLVFEHPQDVPVICDAIRSHPAVREIFEYDIPFAKRYLIDKGFVPMEGGEELKLLEFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 66 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 67 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 68 - protein, 773 aa, synthetic construct
  REGION 1..773: note = Description of Artificial Sequence: Synthetic polypeptide
MILDTDYITENGKPMIRIFKKEKGEFKTEYDRNFEPYIYALLKDDESIEDIKKITGERHGKRVRIIRVEKVKKKFLGEPIEVWKLVFEHPQDVPAICDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 69 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 70 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 71 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 72 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIDVWKLVFEHRQDVPAIRDAIRSHPAVREIFEYDIPFAKRYLIVEGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 73 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLQEWYLLRVAYERNELAPNKPGGEEYQRRMRSSYIGGYVKEPEKGLWESIAHLDFRSSAGSFIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 74 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYIEITIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 75 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 76 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKEVAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 77 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYSYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 78 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWCLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 79 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 80 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 81 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRNAIRSHPAVSEIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 82 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 83 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 84 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYCKECAESVTAWGCHYIETTIKEAEKFGFKVLYADTDGFFATIPNEKLETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 85 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 86 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 87 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANGYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 88 - protein, 773 aa, synthetic construct
  REGION 1..773: note = Description of Artificial Sequence: Synthetic polypeptide
MILDTDYITENGKPVIRIFKKEKGEFMIEYDRNFEPYIYALLEDDESIEDIKKITGERHGKKVRIIRVEKVKKKFLGEPIEVWKLVFEHPQNVPAIRDAIRSHPAVREIFEYDIPFAKRYLIDKGLVPMEGGEELKLLASAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 89 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 90 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQTKVLELILREGSIEKAAGIVKKVVEDLENYRVPVEKLIIHEQITRELKDYKTTGPHVAIAKRLQARGIKVKPGTIISYVVLKGSIKISDRVILFDEYDSSRHKYDPDYYIHNQVLPAVLRILEALGFKEKDLEYQRMKQTGLGAWLKMGKK

SEQ ID NO: 91 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILRESSIEKAAGIVKKEVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 92 - protein, 773 aa, synthetic construct
  REGION 1..773: note = Description of Artificial Sequence: Synthetic polypeptide
MILDTDYITENGKPVIRIFKEEKGEFKIVYDRNFEPYIYALLDDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 93 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKEAGIVKKVVEDLANYRVPVERLIIHEQITRELKDYKATGPHVVIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 94 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVDPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 95 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKSGGEEYQRRMRSSYIGGYVKEPEKGLWESIAYLDFRSSAGSIIMTHNVSPDTLEKECKNYDVAPIVGYRFCKDFKDFIPSILENLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 96 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGSYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 97 - protein, 773 aa, synthetic construct
  REGION 1..773: note = Description of Artificial Sequence: Synthetic polypeptide
MILDTDYITENGKPVIRIFKKEKGEFKIEYDRNFGPYIYALLEDDESIEDIKKITGERHGKKVRITRVEKVKKKFLGEPIEVWKLDFEHPQDVPAIREAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 98 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDAPAIRDAIRSHPAVREIFEYDIPFAKRYLIDKGLVPMGGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 99 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYAGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 100 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 101 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 102 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 103 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDVSIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 104 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 105 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGRYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 106 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVCRSSTGNLVEWNLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 107 - protein, 773 aa, synthetic construct
  REGION 1..773: note = Description of Artificial Sequence: Synthetic polypeptide
MILDTDYITENGKPVIRIFKKEKGEFKNEYDRNFEPYIYALLEDDESIEDIKKITGERHGKKVRIIRVEKVKKKFLGEPIEVWKLVFEHPQDVPAISDAIRSHPAVRVIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 108 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELEDYKATGPHVAIAKREQARGIKVKPGTIISYVVLKGSKKISDRVIQFDVYDSSHHKYDPDYYIHNQVLPAVLRILEAFGYKEKDLEYQRMKLTGLGAWLKMGKK

SEQ ID NO: 109 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 110 - protein, 773 aa, synthetic construct
  REGION 1..773: note = Description of Artificial Sequence: Synthetic polypeptide
MILDTDYITENGKPVIRIFKKEKGEFKIEYDRNFEPYIYALPEDDESIEDIKKITGERHGKKVRFIRVEKIVKKFLGEPIEVWKLVFEHPQDVPAICDATRSHTAVREIFEYDIPFAKRYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 111 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 112 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDQANYRVPVEKLIIHEQITRELKDYKATGPHVAIAKRLQARGIKVKPGTIKSYVVLKGSKKISDRVILFDEYDSSRHKYDPDYYIHNQVLPAVLRILEAFGYKEKDLEYQRMKQTGLGAWLKMGKK

SEQ ID NO: 113 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 114 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERLGKKDRIIRMEKVKKKFLGEPIEVWKLVFEAPQDVPAIRDAIRSHPAVREIFECDIPFAKRYLNDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 115 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGEHHGKKVRIIRVKKVKKKFLGEPIEVWKLVFEHPLDVPAIRDAIRGHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 116 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKTTGERHGKKVRIIRVEKVKKKFLGEPIEVWKLVFEHPQDVPAIRDAIRSHPAVREIFEYGIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 117 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILCEGSIEKAAGIVKKVVEDLVNHRVPVEELIIHEQITRELKDYKATGPHVAIAKRLQARGIKVKPGTIISYVVLKGSKKISDRVILFDKYDSSRHKYDPDYYIHNQVLPAVLRILEAFGYKEKDLEYQRMKQTGLGAWLKMGKK

SEQ ID NO: 118 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 119 - protein, 773 aa, synthetic construct
  REGION 1..773: note = Description of Artificial Sequence: Synthetic polypeptide
MILDTDYITENGKPVIRIFKKEMGEFKIEYVRNIEPYIYALLEDDESIEDIKKITGERHDKKVRIIRMEKVKKKFLGEPIEVWKLIFEHPQDVPAIHDAIRSHPAVCEISEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 120 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKEIQAKVLEVILREGSIEKAAGIVKKVVEDLANYRVPVEKLIIHEQVTRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 121 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 122 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 123 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 124 - protein, 773 aa, synthetic construct
  REGION 1..773: note = Description of Artificial Sequence: Synthetic polypeptide
MILDTDYITENGKPVIHIFKKEKGEFKIEYDRNFEPYIYALLEDDESIEDIKKITGERHDKKVRIIRVEKVKKKFLGEPIEVWKLVFEHPQDVPAIRDAIRSHPAVREIFEYDIPFAKRYLIEKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 125 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 126 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 127 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERSELAPNKPGGEEYQRRMRSSYIGGYVKEPEKGLWESIAYLDFRSSAGSIIVTHNISPDTLEKECKNYDVAPFVGYRFCKDFKGFIPSIQEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 128 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKSTGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 129 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 130 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRSLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 131 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERYGKKVRIIRVEKVKKKFLGEPIEVWKLVFEHPQDVPAIRDAIRSHPAVREIFGYDIPFAKRYLIDKGLVPKEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 132 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 133 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 134 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKNTGERHGKKVRIIRVEKVKKKFLGEPIEVWKLVFEHPQDVPAIRDAIRSHPAVREIFEYDIPFTKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 135 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 136 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILHEGSIEKAAGIVKKVVEDLANYRVPVEKLIIHEQITRELKDYKATGPHVAIAKRLQARGIKVKPGTIISYVVLKGCKKISDRVILFDEYDSSRHKYDPDYYIHNQVLPAVLRILEAFGYKEKDLEYLRMKQTGLGAWLKMGKK

SEQ ID NO: 137 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHRQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 138 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPFVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRIAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 139 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 140 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 141 - protein, 773 aa, synthetic construct
  REGION 1..773: note = Description of Artificial Sequence: Synthetic polypeptide
MILDTDYITENGKPVIRISKKEKGEFKIEYDRNSEPYIYALLEDDESIEDIKKIIGERHGKKVRIIRVEKVKKKFLGEPIEVWKLVFEHPQDVPAIRDAIRSHPAVREIFEYDTPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 142 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSRPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 143 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVSVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 144 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 145 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 146 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHLQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 147 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILHEGSIEKAAGIVKKVVEDLANYRVPVEKLIIHEQITRELKDYKATGPHVAIAKRLRARGIRVKPGTIISYVVLKGSKKISDRVILFDEYDNSRHKYDPDYYIHNQVLPAVLRILEAFGYKEKDLEYLRMKQTGLGAWLKMGKK

SEQ ID NO: 148 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 149 - protein, 773 aa, synthetic construct
  REGION 1..773: note = Description of Artificial Sequence: Synthetic polypeptide
MILDTDYITENDKPVIRIIKKEKGEFKIEYDRNFEPYIYALLEDDESIEDIKKITGKRHSKKVRIIRVEKVKKKFLGEPIEVWKLVFEHPQDVPAIRDAICSHPAVREIFEYDIPFAKRYLIGKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 150 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 151 - protein, 773 aa, synthetic construct
  REGION 1..773: note = Description of Artificial Sequence: Synthetic polypeptide
MILDTDYITENGKPVNRIFKKEKGEFKIEYDRNSEPYIYALLEDDESIEDIKKITGERHGKKVRIIRVEKVKKKFLGEPIEVWKLVFEHPQDVPAIRDAIRSHPAVREIFEYDIPFAMRYLIDKGLVPMEGGEELRLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 152 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSSPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 153 - protein, 773 aa, synthetic construct
  REGION 1..773: note = Description of Artificial Sequence: Synthetic polypeptide
MILDTDYITENGKPVIRIFKKEKGEFKNEYDRNFEPYIYALLEDDESIEDIKKITGECHGKKVRIIRVEKVKKKFLGEPIEVWKLVFEHLQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 154 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSCTGNLVEWYLLRVAYERNELAPNKPGGEEYQRRMRSSYIGGYVKEPEKGLWESIAYLDFRSSAGSIIVTHNVSPVTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 155 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEDIKKITGERHGKKVRIIRVEKVKKKFLGEPIEVWKLVFEHPQDVPAIRDAIRSHPAVREIFVYDIPFAKRYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 156 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 157 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 158 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVSAIRDAIRSHPAVREIFEYDIPFAKCYLIDKGPVPMTGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 159 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYAGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 160 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRMEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 161 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 162 - protein, 773 aa, synthetic construct
  REGION 1..773: note = Description of Artificial Sequence: Synthetic polypeptide
MILDTDYITENSKPVIRIFKKEKGEFKIEYDRNFEPYIYALLEDDESIGDIKKITGERHGKKVRIIRVEKVKKKFLGEPIEVWKLVFEHPQDMPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 163 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEDIKKITGERHGKKVRIIRVEKVKKKFLGEPIEVWKLVFEHPQDVPAICDAIRSHPAVRENFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 164 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 165 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHLQDVPVIRDAIRSHPAVREIFEYDILFAKRYLIDKGLVPMDGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 166 - protein, 773 aa, synthetic construct
  REGION 1..773: note = Description of Artificial Sequence: Synthetic polypeptide
MILDTDYITENGKPVIRIYKKEKGEFKIEYDRNFEPYIFALLEDDESIEDIKKITGERHGKKVRIIRVEKVKKEFLGEPIEVWKLVFEHPQDVPAIRDAIRSHPAAREIFEYDIPFAKRYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 167 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 168 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 169 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 170 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLKDDESIEDIKKITGERHGKKVRIIRVEKVKKRFLGEPIEVWKLVFEHPQDVPAIRDAIRSHPAVREIFEYDIPFAKRYLIDKGLVPMEGGEEQKLPAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 171 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYNGYQGYPKARWYSLECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 172 - protein, 773 aa, synthetic construct
  REGION 1..773: note = Description of Artificial Sequence: Synthetic polypeptide
MILDTDYSTENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 173 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 174 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKRFLGEPNEVWKLVFEHLQDVPAIRDAIRSHPAVREIFEYDIPSAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 175 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRDAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 176 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVERYLLRVAYERNELAPNKPGGEEYQRRMRSSYIGGYVKEPEKSLWESIAYLDFRSSAGSIIVTHNVSPDTLEKECKNYDVVPIVGYHFCKDFKGFIPSILEDLIETRQKVKRKMKATIDPVEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 177 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 178 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 179 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 180 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 181 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGRVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 182 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFAMEVELAKLIGQSVWDVSRSSTGNMVEWYLLRVAYERNELAPNKPGGEEYQRRMRSSYIGGYVKEPEKGLWESITYLDFRSSAGSIIVTHNVSPDTLEKGYKNYDVAPTVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 183 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKVSDRVILFDEYESSRHKYDPDYYIHNQVLPAVLRILEAFGYKEKDLEYQRMKQTGLSAWLKMGKK

SEQ ID NO: 184 - protein, 773 aa, synthetic construct
  REGION 1..773: note = Description of Artificial Sequence: Synthetic polypeptide
MILDTDYITENGKPVIRIFKKEKGEFMIEYDRNFEPYIYALLEDVESIEDIKKITGECHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 185 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIARETQAKVLELILREGSIEKAAGFVKKVVEDLANYRVPIEKLIIHEQVTRELKDYKATGPHVAIAKRLQARGIKVKPGTIISYVVLKGNKKISDRVILFDEYDSSRHKYDPDYYIHNQVLPAVLRILEAFGYKEKDLEYQRMKQTGLGAWLKMGKK

SEQ ID NO: 186 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 187 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVLAIRDAIRSRPAVREIFEYDILFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 188 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 189 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYAGYQGYPKARWYSLECAERVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 190 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRRRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 191 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 192 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 193 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 194 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLVDDESIEDIKKITGERHGKKVRIIRVEKVKKKFLGEPIEVWKLVFEHPQDVPAICDAIRSHPAVREIFEYDIPFAKRYLIDKGLVLMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 195 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEYAESVTAWGRHYIETTIKEAEKFGFKVLYADTDGFFATIPNEKPETIKSKAKKFLKYINEELPGMLELEYEGFYLRGFFVTKKKYALIDEDGHITTRGLEVVRRDWSEVAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 196 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 197 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 198 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 199 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 200 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 201 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKKTQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAILRILEAFGYKEKDLEYQRMKQTGLGAWLKMGKK

SEQ ID NO: 202 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYAGYQGYPKARWYSLECAERVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 203 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLKVILREGSIEKAAGIVKKVVEDLANYRVPVEKLIIVEQITRGLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 204 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 205 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYAGYQGYPKARWYSLECAERVTAWGRHYIETTIKEAEKFGFKVLYADTDGFFATIPNEKPETIKSKAKKFLKHINEKLPGMLELEYEGFYLRGFFVTKKQYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 206 - protein, 773 aa, synthetic construct
  REGION 1..773: note = Description of Artificial Sequence: Synthetic polypeptide
MILDTDYITENGKPVIRIYKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 207 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 208 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 209 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSSIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 210 - protein, 773 aa, synthetic construct
  REGION 1..773: note = Description of Artificial Sequence: Synthetic polypeptide
MILDTDYITVNGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 211 - protein, 773 aa, synthetic construct
  REGION 1..773: note = Description of Artificial Sequence: Synthetic polypeptide
MILDTDYITENGEPVIRIFKKEKGEFKIEYDRNFEPYIYALLEDDESIEDIKKITGERHGKKVRIIRVEKVKKKFLGEPIEVWKLVFEYPQDVPAIRDAIRSHPAVREIFEYDIPLAKRYMIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 212 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGLHVAIAKHLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 213 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPFEVWKLVFEHPQDVPAIRDAICSHPAVREIFEYDISFAKRYLIDKGLVPMDGGEELKLLAFAVATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 214 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEVIKKITGERHGKKVRIIRVEKVKKKFLGEPIEVWKVVLEHPQDVPAIPDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 215 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIICVEKVKKKFLGEPNEVWKLVFEHPQDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 216 - protein, 773 aa, synthetic construct
  REGION 1..773: note = Description of Artificial Sequence: Synthetic polypeptide
MILDTDYITENGKPVIRIFKKEKGEFKIEYDRNFDPYIYALLEDDESIEDIKKITGECHGKKVRIIRVEKVKKKFLGKPNEVWKLVFEHSQDVPAIRDAIRSHPAVREIFEYDIPFAKRYLIDKGLVPMKGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 217 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYQDFRSSAGSIIVTHNVSPDTLEKECKNYDVAPIVGYRFCKDFKGINPSILEDLIETRQKVKRKMRATIVPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 218 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 219 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVIEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 220 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 221 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATSPHVAIAKRLQARGIKVKPGTIISYVVLKGSKKISDRVILFDEYDSSRHKYDPDYYIHNQVLPAVLRILEVFGYKEKDLEYQHMKQTGLGAWLKMGKK

SEQ ID NO: 222 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANGYYGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 223 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 224 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 225 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 226 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVFLREGSIEKATGIVKKVVEDLANYRVPVEKLIIHEQITRELKDYKATGPHVAIAKRLQARGIKVKPGTIISYVVLKGSKKISDRVILFDEYDSSRHKYDPDYYIHNHVLPAVLRILEVFGYNEKDLEYQRMKQTGLGAWLKMGKK

SEQ ID NO: 227 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 228 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKEVRIIRVEKVKKKFLGEPIEVWKLVFEHPQDAPAIRDAIRSHPAVREIFEYDIPFAKRYLIDKGLVPVEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSESKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 229 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVGDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 230 - protein, 773 aa, synthetic construct
  REGION 1..773: note = Description of Artificial Sequence: Synthetic polypeptide
MILDTDYITENGKPVIRIFKKEKSEFKIEYDRNFEPYIYALLEDDESIEDIKKITGELHGKKVRIIRVEKVKKKFLGEPIEVWKLVFEHPQDVPAIRDAIRSHPAVREILEYDIPFAKHYLIDKGLVPIEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 231 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 232 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGNPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYAGYQGYPKARWYSLECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 233 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANGYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 234 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVDRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVIPFDEYDSSRHKYDPDYYIHNQVLPAVLRILEAFGYKEKDLEYQRMKQTGLGAWLKMGKK

SEQ ID NO: 235 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKISSECHGKKVRIIRVEKVKKKFLGEPIEVWKLVFEHPQDVPAIHDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 236 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPLEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 237 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYYGYQGYPKARWYSKECAESVTAWGRHYHETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 238 - protein, 773 aa, synthetic construct
  REGION 1..773: note = Description of Artificial Sequence: Synthetic polypeptide
MILDTDYITENGKPVIRIFKKEKGEFKIEYDRNFEPNIYALLEDDEGIEDIKKITGERHGKKVRIIRVEKVKKKFLGEPIEVWKLVFEHPQDVPAIHDAIRSHPAVREIFEYDIPFARRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 239 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRNYNETTIKEAEKFGFKVLYADTDGFFATFPNEKPETIKSKAKKFLKHINEKLPGMLELEYEGFYLRGFFETKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 240 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIKTHNVSPDTLEKECKNYDVDPIVGYRFCKDFKGFIPSILEDLIETRQKVKRKMKATIDPIEKKMLDYRQRSLKILANSYAGYQGYPKARWYSLECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 241 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 242 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKESQAKVLEVILREGSIEKAAGIVKKVVEDLANYRVPVEKLIIHEQITRGLKDYKATGPHVAIAKRLQARGIKVKPGTIISYVVPKGSKKISDRVILFDKYDSSRHKYDPDYYIHNQVLPAVLRILEAFGYKEKDLEYLRMKQTGLGAWLKMGKK

SEQ ID NO: 243 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 244 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPADVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 245 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKQCAKSVTAWGRHYIETTIKEAEKFGFKVLYADTDGFFATTPNEKPETIKSKAKKFLKHINEKLPGMLELEYEGFYLRGFFVTKKKYALIDEDGRITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 246 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYIATGPHVAIAKRLQARGIKVKPGTIISYVVLKGSKKISDRVILFDEYDCSRHKYDPDYYIHNQALPAVLRILEAFGYKEKDLEYQRMKQTGLGAWLKMGKK

SEQ ID NO: 247 - protein, 773 aa, synthetic construct
  REGION 1..773: note = Description of Artificial Sequence: Synthetic polypeptide
MILDTDYITENGKPVTRIFKKEKGEFKIEYDRNFEPYIYALLEDDESIEDIKKITGERHSKKVRTIRVEKVKKKFLGEPIEVWKLVFEHPQDVPAIRDTIRNHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 248 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVRKKFLGEPIEVWKLVFEHPQDVPVIRDAIRSHPAVCEIFVYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 249 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 250 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRALKILANSYYGYQGYPKARWYSLECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 251 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHDQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 252 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 253 - protein, 773 aa, synthetic construct
  REGION 1..773: note = Description of Artificial Sequence: Synthetic polypeptide
MILDTDYITENGKPVIRIFKKEKGEFKIEYDRNFEPYNYALLEDDESIEDIKKITGERHGKKVRIIRVEKVKKKFLGEPIEVWKLVFEHPQDVPVIRDAIRSHPAVREIFEYDIPFAKRYLFDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 254 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVQAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 255 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKIKKKFLGEPIEVWKLVFEHPQDVPAIRDAIRSHPAVREIFEYDIPFAKRYLFDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 256 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIRTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 257 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 258 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 259 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 260 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGSPIEVWKLVFEHPQDVPAIRDAIRSHPAVREIFEYDIPFVKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAPSIIVTHNVSPDTLEKECKNYDVDPIVGYRFCKDFKGFIPSILEDLIETRQKVKRKMKATIDPIEKKMLDYRQRSLKILANSYYGYQGYPKARWYSKECAESVTAWGRHYTETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHKQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 261 - protein, 773 aa, synthetic construct
  REGION 1..773: note = Description of Artificial Sequence: Synthetic polypeptide
MILDTDYITENGKPVIRIFKKEKGEFKIEYDRNFEPYIYVLLEDDESIEDIKKITGERHGKKVRIIRVEKVKKKFLGEPIEVWKLVFEHPQDVPAIRDAIRSHPAVREIFEYDIPFAKSYLIDKGLVPMEGGEELRLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 262 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKCLGEPIEVWKLVFEHPQVVLAIRDAIRSHPAVREIFEYDIPFAKRCLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 263 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIKTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 264 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 265 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIDQSVWDVSRSSTGNLVEWYLLRVAYERNELAPNKPGGEKYQRRMRSSYIGGYVKEPEKGLWESIAYLDFRSSAGSIIVTHNVSPDTLEKECKNYDVAPIVGYRFCKDFKGFFPNILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 266 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIGKAAGIVKKVVEDLANYRVPVEKLIIHEQITRELKDYKATGPHVAIAKRLQARGIKVKPGTIISYVVLKGSKKISGRVILLDEYVSSRHKYDLDHYIHNQVLPAVLRILEAFGYKEEDLEYQRMKQNGLGAWLKMGKK

SEQ ID NO: 267 - protein, 773 aa, synthetic construct
  REGION 1..773: note = Description of Artificial Sequence: Synthetic polypeptide
MILDTDYITENGKPVIRIFKKEKGEFKFEYDRNFEPYIYALLEDDESIEDIKKITGERHGKKVRIIRVEKVKKKFLGEPIEVWKLVFEHPQDVPAIRDAIRSHPAVREIFEYDIPFAKRYLFDKGLVPMEGGEEMKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 268 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGCIEKAAGIVKKIVEDLANYCVPVEKLIIHEQITRELKDYKATGPHVAIAKRLQARGIKVKPGTIISYVVLKGSKKISDRVILFDEYDSSRHKYDPDYYIHNQALPAVLRILEAFGYKEKDLEYQRMKQTGLGAWLKMGKK

SEQ ID NO: 269 - protein, 773 aa, synthetic construct
  REGION 1..773: note = Description of Artificial Sequence: Synthetic polypeptide
MILDTDYITENGKPVFRIFKKEEGEFKIEYDRNFEPYIYAPLEDDESIKDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 270 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLENDERIEDIKKITGERHGKKVRIIRVEKVKKKFLGEPIEVWKLVIEHPQDVPAIRDAIRSHPAVREIFEYDIPFAKRNLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 271 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 272 - protein, 773 aa, synthetic construct
  REGION 1..773: note = Description of Artificial Sequence: Synthetic polypeptide
MILNTDYITENGKPVIRIFKKEKGEFKIEYDRNFEPYIYALLEDDESIEDIKKITGERHGKKVRIIRVEKVKKKFLGEPIEVWKLVFEHPQDVPVIRDAIRSHPAVREIFEYDIPFAKHYLIDKGLVPMEGGEELKLLAYAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 273 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDVNIEDIKKITGGRHGKKVRIIRVEKVKKKFLGEPIEVWKLVFEHPHDVPAIRDAIRSHPAVREKFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 274 - protein, 773 aa, synthetic construct
  REGION 1..773: note = Description of Artificial Sequence: Synthetic polypeptide
MILDTDYITENGKPVTRIFKKEKGEFKIEYDRNFEPYIYALLEDDESIEDIKKITGERHGKKIRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 275 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIIIYVVLKGSKKISDRVILFDEYDSSRHKYDPDYYIHNQVLPAVLRILEAFGYKEKDLECQRMKQTGLGAWLKMGKK

SEQ ID NO: 276 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 277 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGSVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 278 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 279 - protein, 773 aa, synthetic construct
  REGION 1..773: note = Description of Artificial Sequence: Synthetic polypeptide
MILDTDYITENGKPVIRIFKKEKGEFKIEYDRNFELYIYALLEDDESIEDIKKITGERHGKKVRIIRVEKVKKKFLGEPIEVWKLVFEHPQDVPAIRDAIRSHPAVREIFEYDIPFAKRYLIDKGLVPMGGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 280 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEVLANYRVPVEKLIIHEQITRKLKDYKVTGPHVAIAKRLQARGIKIKPGTIISYVALKGSKKISDRVILFDEYDSSRHKYDPDYYIHNHVLPAVLRILEAFGYKEKDLEYQRMKQTGLGAWLKMGKK

SEQ ID NO: 281 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGGRHGKKVRIIRVEKVKKKFLGEPIEVWKLVFEHPQDVPAILDAIRSHPAVREIFEYYIPFAKRYLIDKGLVPMKGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 282 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAICSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 283 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDYRSSAGNIIVTHNVSPDTLEKECKNYDVAPIVGYRFCKDFKGLIPSILEDLIETRQKVKRKMKATIDPFEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 284 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 285 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVFQREGSIEKAAGIIKKVVEDLANYRVPVEILIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 286 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGSLVEWYLLRVAYERNELAPNKPGGEEYQRRIRSSYIGGYVKEPEKGLWESIAYLDFRSSAGSIIVTHNVSPDTLEKECKNYDVAPIVGYRFCKDFKGFILSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 287 - protein, 773 aa, synthetic construct
  REGION 1..773: note = Description of Artificial Sequence: Synthetic polypeptide
MILDTDYITENGKPVIRIFKKEKGELKIEYDRNFEPYTYALLEDDESIEDIKKITGERHGKKVRIIRVEKVKKKFLGEPIEVWKLIFEHPQDVPAIRDAICSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 288 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 289 - protein, 773 aa, synthetic construct
  REGION 1..773: note = Description of Artificial Sequence: Synthetic polypeptide
MILDTDYITENGKPVIRIFKKEKGEFKIDYDRNFEPYIYALLEDDESIEGIKKITGERHGKKVRIIRVEKIKKKFLGEPIEVWKLVFEHPQDEPAIRDAIRSLPATREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 290 - protein, 773 aa, synthetic construct
  REGION 1..773: note = Description of Artificial Sequence: Synthetic polypeptide
MILDTDYITENGKPVIRIFMKEKGEFKIEYDRNFELYIYGLLEDDESIEDIKKITGERHGKNVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 291 - protein, 773 aa, synthetic construct
  REGION 1..773: note = Description of Artificial Sequence: Synthetic polypeptide
MILDTRYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 292 - protein, 773 aa, synthetic construct
  REGION 1..773: note = Description of Artificial Sequence: Synthetic polypeptide
MILDTDYITENGKPVIRIFKKEKGEFKIEYDRNSEPYIYALLEDVESIEDIKKIAGERHGKKVRIIRVEKVKKKFLGEPIEVWKLVFEHPQDVPAIRDAIRSHPAVREIFEYDIPFAKRYLFDKGLVPMEGSEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 293 - protein, 773 aa, synthetic construct; identical to SEQ ID NO: 245
  REGION 1..773: note = Description of Artificial Sequence: Synthetic polypeptide

SEQ ID NO: 294 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 295 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDMPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 296 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 297 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 298 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTINLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 299 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWEVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 300 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 301 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEVLANYRVPVEKLIIHEQITRELKDYKATGPHVAIAKRLQARSIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 302 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSNEKAAGIVKKVVEDLANYRVPVEKLIIHEQITRELKDYKATGPHVAIAKRLQARGIKVKPGTIISYVVLKGSKRISDRVILFDEYDSGRHKYDPDYYIHNQVLPAVLRILEAFGYKEKDLEYQRMKQTGLGAWLKMGKK

SEQ ID NO: 303 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVQRILEAFGYKEKDLEYQRMKQTGLGAWLKMGKK

SEQ ID NO: 304 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYELEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 305 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 306 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLTNYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 307 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 308 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILVAFGYKEEDLEYQRMKQTGLGAWLKMGKK

SEQ ID NO: 309 - protein, 772 aa, synthetic construct
  REGION 1..772: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLYQRMKQTGLGAWLKMGKK

SEQ ID NO: 310 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 311 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 312 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEGWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 313 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTEGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 314 - protein, 756 aa, synthetic construct
  REGION 1..756: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQFTRELKDYKATGPHVAIAKRLQARGIKVKPGTIISYVVLKGSIKVSDRVILFDEYDGSRHKYDPDYYIHNQVLPAVLRILEAFGYKEKDLEY

SEQ ID NO: 315 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 316 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIKKAAGIVKKVVEDLANYRMPVEKLIIHEQITRELKDYKATGPHVAIAKRLQARGIKVKPGTIISYVVLKGGKKISDRVILFDEYDSSRHKYDPDYYIHNRVLPAVLRILEAFGYKEKDLEYQRMKQTGLGAWLKMGKK

SEQ ID NO: 317 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 318 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEAARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 319 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAETDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 320 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 321 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAATDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 322 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSNKISDRVILFDEYDSSRHKYDPDYYIHNQVLPAVLRILEAFGYKEKDLEYQRMKQTGLGAWLKMGKK

SEQ ID NO: 323 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 324 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKKTQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 325 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 326 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 327 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 328 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 329 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDTPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 330 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTWNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 331 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 332 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMSDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 333 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 334 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 335 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 336 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNEDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 337 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 338 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDTPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 339 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 340 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 341 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLLARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 342 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGSLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 343 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDHFAVEVKGRIHLDLAPVVRHTIRLSTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 344 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 345 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILHEGSIEKAAGIVKKVVEDLANYYVPVEKLIIHEQITRELKDYKATGPHVAIAKRLQARGIKVKPGTIISYVVLKGSKKISDRVILFDEYDSGRHKYDPDYYTHNHVLPAVLRILEAFGYKEKDLEYQRMKQTGLGAWLKMGKK

SEQ ID NO: 346 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAIVLEVILREGSIEKAADIVKKVVEDLANYRVPVEKLIIHEQITRELKDYKASGPHVAIAKRLQARGIKVKPGTIISYVVLKGSKKISDRVILFDEYDSSRHKYDPDYYIHNRVLPAVLRILEAFGYKEKDLEYQRMKQTGLGAWLKMGKK

SEQ ID NO: 347 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGVKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 348 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 349 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPPDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 350 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 351 - protein, 773 aa, synthetic construct
  REGION 1..773: note = Description of Artificial Sequence: Synthetic polypeptide
MILDTDYITENGKPVIRIFKKEKGEFKIEYDRNFEGYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 352 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 353 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVATARRLQARGIKVKPGTIISYVVLKGSKKISDRVILFDVYDSSRHKYDPDYYIHNQVLPAVLRILEAFGYKKKDLEYQRMKQTGLGAWLKMGKK

SEQ ID NO: 354 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEFYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 355 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELRRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 356 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 357 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVIEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 358 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTISLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 359 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 360 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 361 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 362 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTENGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 363 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 364 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 365 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 366 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLEPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 367 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGSIISYVVLKGSKKISDRVILFDEYDSSRHKYDPDYYIHNQVLPAVLRILEAFGYKEKDLEYQRMKQTGLGAWLKMGKK

SEQ ID NO: 368 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVREDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 369 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 370 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 371 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKLIIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 372 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLRVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGPKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 373 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 374 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIIKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 375 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 376 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANCRVPVEKLIIHEQITRGLKDYKASGPHVAIAKRLQARGVKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 377 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 378 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPYYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 379 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKASGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 380 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFARRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 381 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 382 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYYSSRHKYDPDYYIHNQVLPAVLRILEAFGYKEKDLEYQRMKQTGLGAWLKMGKK

SEQ ID NO: 383 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNADFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 384 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 385 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDFKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 386 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 387 - protein, 773 aa, synthetic construct; identical to SEQ ID NO: 303
  REGION 1..773: note = Description of Artificial Sequence: Synthetic polypeptide

SEQ ID NO: 388 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAGTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 389 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGNSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 390 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNSDNFDFAYIKKRCEKLGLKFTIGRDGSEPKIQRMDDRFVVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 391 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREDSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 392 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 393 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 394 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDYFDFAYIKKRCEKLGPKFTIGRDGSEPKIQRMGDRFAVEVKGRIHLDLAPVVRHTIRLPTYTLEAVYEAVFGKKKEKVYAEEIAEAWKSEEGLKRVAQYSKEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 395 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 396 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 397 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 398 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTPEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 399 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 400 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTMEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 401 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHMQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 402 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 403 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHRQVLPAVLRILEAFGYKEKDLEYQRMKQTGLGAWLKMGKK

SEQ ID NO: 404 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 405 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEEEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 406 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIIKKVVEDLANYRVPVEKLIIHEQITRELKDYKATGPHMAIAKRLQARSIKVKPGSIISYVVLKGSKKISDRVILFDEYDSSRHKYDPDYYIHNQVLPAVLRILEAFGYKEKDLEYQRMKQTGLGAWLKMGKK

SEQ ID NO: 407 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELRDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 408 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVKRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 409 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 410 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECRNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 411 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPAAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 412 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 413 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNADFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 414 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 415 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 416 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 417 - protein, 773 aa, synthetic construct
  REGION 1..773: note = Description of Artificial Sequence: Synthetic polypeptide
MILDTSYITENGKPVIRIFKKEKGEFKIEYDSNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 418 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 419 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQEMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 420 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQASGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 421 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKINRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 422 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLKLEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 423 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKMVEDLANYRVPVEKLIIHEQITRELKDYKATGPHVAIAKRLQARGIKVKPGTIISYVVLEGSKKISDRVILFDEYDSSRHKYDPDYYIHNQVLPAVLRILEAFGYKEKDLEYQRMKQTGLGAWLKMGKK

SEQ ID NO: 424 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 425 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 426 - protein, 772 aa, synthetic construct
  REGION 1..772: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 427 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGLHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 428 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 429 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 430 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEQVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 431 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDALLTYNGDNFDFAYIKKRCEKLGLKFTIGRDGSEPKIQRMGDRFAVEVKGRIHLDLAPVVRHTIRLPTYTLKAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 432 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 433 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 434 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKENVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 435 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRTSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 436 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEFYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 437 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYEEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 438 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWRVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 439 - protein, 773 aa, synthetic construct
  REGION 1..773: note = Description of Artificial Sequence: Synthetic polypeptide
MILDTDYITENGKPVIRIFKKEKGEFKIEYDRNFEMYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 440 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKRISDRVILFDEYDSSRHKYDPDYYIHNQVLPAVLRILEAFGYKEKDLEYQRMKQTGLGAWLKMGKK

SEQ ID NO: 441 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 442 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 443 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARSIKVKPGTIISYVVLKGSKKISDRVILFDEYDSSRHKYDPDYYIHNQVLPAVLRILEAFGYKEKDLECQRMKQTGLGAWLKMGKK

SEQ ID NO: 444 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 445 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYFHNQVLPAVLRILEAFGYKEKDLEYQRMKQTGLGAWLKMGKK

SEQ ID NO: 446 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRKGDRFAVEVKGRIHLDLAPVIRHTIRLPTYTLEAVYEAVFGKKKEKVYAEEIAEAWKSEEGLKRVAQYSLEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 447 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYVKKRCEKLGLKFTIGRDGSEPKIQRMGVRFAVEVKGRIHLDLVSVVRHSIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 448 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 449 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPAEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 450 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 451 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFDIETFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 452 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRIILFDEYDSSRHKYDPDYYIHNQVLPAVLRILEAFGYKEKDLEYQRMKQTGLGAWLKMGKK

SEQ ID NO: 453 - protein, 772 aa, synthetic construct
  REGION 1..772: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 454 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFKSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 455 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 456 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHIDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 457 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVKDLANYRVPVEKLIIHEQIARELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 458 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVFLREGSIEKAAGIVKKVVEDLANYRVPVEKLIIHEQITRELKDYKATGPHVAIAKRLQARGIKVKPGTIISYVVLKGSKKISDRVILFDEYDSSRHRYDPDYYIHNQVLLAVLRILEAFGYKEKGLEYQRMKQTGLGAWLKMGKK

SEQ ID NO: 459 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 460 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLWPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 461 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLHEKDPDVLLTYNGDNFDFAYIKKRCEKLGLKFIIGRDGSEPKIQRMGDRFAVEVKGRIHLDLAPVVRHTIRLPTYTLEAVYEAVFGKKKEKVYAEEIAEGWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 462 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 463 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 464 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEEVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 465 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGEHHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 466 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFARRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 467 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATFELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 468 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKGSGISAMKQTGLGAWLKMGKK

SEQ ID NO: 469 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYELEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 470 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 471 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVERDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 472 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTPEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 473 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 474 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGLHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 475 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 476 - protein, 773 aa, synthetic construct
  REGION 1..773: note = Description of Artificial Sequence: Synthetic polypeptide
MILDTDAITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 477 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGVVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 478 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCVKLGLKFTIGRDGSEPKIQRMGDRFAVEVKGRIHQDLAPVVRHTIRLPTYTLEAVYEAVFGKKREKVYAEEIAEAWKSEEGLKRVAQYSMEDARATYELGREFFPMEVKLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 479 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDYFDFAYIKKRCEKLGLKFTIGRDGSEPKIQRMGDRFAVEVKGRIHLDLAPVVRHTIRLPTYSLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 480 - protein, 773 aa, synthetic construct; identical to SEQ ID NO: 456
  REGION 1..773: note = Description of Artificial Sequence: Synthetic polypeptide

SEQ ID NO: 481 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYTEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 482 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWNVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 483 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEEVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 484 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDKPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 485 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGQLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 486 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSVEKAAGIVKKVVEDLANYRVPVEKLIIHEQITRELKDYKATGPHVAIAKRLQARGIKVKPGTIISYVVLKGSKKFSDRVILFDEYDSSRHKYDPDYYIHNQVLPAVLRILEAFGYKEKDLEYQRMKQTGLGAWLKMGKK

SEQ ID NO: 487 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 488 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 489 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFAHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 490 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGFPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 491 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYWLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 492 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEENAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 493 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 494 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 495 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVSRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 496 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 497 - protein, 773 aa, synthetic construct
  REGION 1..773: note = Description of Artificial Sequence: Synthetic polypeptide
MILDTDYITENGKPVIRIFKKEKGEFKIEYDRNFEPFIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 498 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHMAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 499 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPAYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 500 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDEFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 501 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKRGTIISYVVLKGSKKISDCVILFDEYDSSRHKFDPDYYIHNQVLPAVLRILEAFGYKEKDLDYQRMKQTGLGAWLKMGKK

SEQ ID NO: 502 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGFPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 503 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 504 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEEARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 505 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 506 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEAARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 507 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKAIGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 508 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPVYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 509 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNWDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 510 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPLYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 511 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 512 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPKDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 513 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 514 - protein, 773 aa, synthetic construct
  REGION 1..773: note = Description of Artificial Sequence: Synthetic polypeptide
MILRTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 515 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYVDTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 516 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRELKDFKATGPHVAIAKRLQARGFKVKPGTIISYVVLKGSKKISDRVILFDEYDSSRHKYDPDYYIRNQVLPAVLRILEAFGYKEKDLEYQRMKQTGLGAWLKMGKK

SEQ ID NO: 517 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTGGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 518 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 519 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 520 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 521 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKVAGIVKKVVKDLANYRVPVEKLIIHEQITRELKDYKATGLHVAIAKRLQARGIKVKPGTIISYVVLKGSKKISDRVILFDEYDSSRHKYDPDYYNHNQVLPAVLLEAFGYKEKDLEYQRMKMKQTGLGAWLKMGKK

SEQ ID NO: 522 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFNSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 523 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHVQITRELKDYKATGPHVAIAKRLQARGIKVKPGTIISYVVLKGSKKISDRVILFDEYDSGRHKYDPDYYIHNQVLPAVLRILEAFGYKEKDLEYQRMKQTGLGAWLKMGKK

SEQ ID NO: 524 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREVIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 525 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 526 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWRVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 527 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 528 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 529 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREVIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGIKKEKVYAEEIAEAWKSEEGLKRVAQYSIEDARATYELGREFFPMEVKLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 530 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYHVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 531 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPHDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 532 - protein, 773 aa, synthetic construct; identical to SEQ ID NO: 224
  REGION 1..773: note = Description of Artificial Sequence: Synthetic polypeptide

SEQ ID NO: 533 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 534 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 535 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 536 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDVPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 537 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEWARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 538 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 539 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPVVLRILEAFGYKEKDLEYQRMKQTGLGAWLKMGKK

SEQ ID NO: 540 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTANGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 541 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQIARELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 542 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKTYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 543 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKASGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 544 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGIFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 545 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 546 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHKQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 547 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVDHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 548 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYAATAGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 549 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVIEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFVYKEKDLEYQRMKQTGLGAWLKMGKK

SEQ ID NO: 550 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 551 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMADRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 552 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVVKLIIHEQITRELKDYKATGPHVAIAKRLQARGIKVKPGTIISYVVLKGSIKISDRVILFDEYDSSRHKYDPDYYIHNQVLPAVLRILEAFGYKEKDLEYQRMKQTGLGAWLKMGKK

SEQ ID NO: 553 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 554 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTMEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 555 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 556 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVSQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 557 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPEIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 558 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITEELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 559 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDDFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 560 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 561 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 562 - protein, 773 aa, synthetic construct; identical to SEQ ID NO: 452
  REGION 1..773: note = Description of Artificial Sequence: Synthetic polypeptide

SEQ ID NO: 563 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 564 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTWTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 565 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKAAGPHVAIAKRLQARGIKVKPGTIIGYVVLKGSKKISDRVILFDEYDSSRHKYDPDYYIHNQVLPAVLRILEAFGYKEKDLEYQRMKQTGLGAWLKMGKK

SEQ ID NO: 566 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFSHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 567 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIDRDGSEPKIQRTGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 568 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 569 - protein, 773 aa, synthetic construct
  REGION 1..773: note = Description of Artificial Sequence: Synthetic polypeptide
MILRTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 570 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYEATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 571 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKEYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 572 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTAGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 573 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYPRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 574 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDSDVLLTYNGDNFDLAYIKKRCEKLSLKFTIGRDGSEPKIQRMGDRFGVEVKGRIHLDLAPVVRHTIRLPTYTLEAVYEAVFGKKKEKVYAEEIAEAWKSEEGLKRAAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 575 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKAAGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 576 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 577 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 578 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQHMKQTGLGAWLKMGKK

SEQ ID NO: 579 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 580 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 581 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGVKVKPGTIISYVVLKGSKKISDRVILFDEYDSSRHKYDSDYYIHNQVLPAVLRILEAFGYKEKDLEYQRMKQTGLGAWLKMGKK

SEQ ID NO: 582 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 583 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 584 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDKPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 585 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 586 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 587 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFEHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 588 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 589 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATFELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 590 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 591 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 592 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 593 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 594 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKVYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 595 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 596 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQWSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 597 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVIQREGSIEKAAGIVKKVVEDLANYRVPVEKLIIHEQITRELKDYKATGPHVVIAKRLQARGIKVKPGTIISYVVLKGSKKISDRVILFDEYDSSRHKYDPDYYIHNQVLPAVLRILVAFGYKEKDLEYQRMKQTGLGAWLKMGKK

SEQ ID NO: 598 - protein, 773 aa, synthetic construct
  REGION 1..773: note = Description of Artificial Sequence: Synthetic polypeptide
MILDTDFITENGKQVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 599 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 600 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 601 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 602 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDGPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 603 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 604 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARSIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 605 - protein, 773 aa, synthetic construct; identical to SEQ ID NO: 488
  REGION 1..773: note = Description of Artificial Sequence: Synthetic polypeptide

SEQ ID NO: 606 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKVTQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDSDYYIHNQVLPAVLRVLEAFGYKEKDLEYQRMKQTGLGAWLKMGKK

SEQ ID NO: 607 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 608 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTATLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 609 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDDFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 610 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 611 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDSFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 612 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVARRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 613 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRFDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 614 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 615 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEAITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 616 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELIDYKATGPHVAIAKRLQARGIKVKPGTIISYVVLKDSKKISDRVILFDEYDSSRHKYDPDYYIHNQVLPAVLRILEAFGYKEKDLEYQRMKQTGLGAWLKMGKK

SEQ ID NO: 617 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 618 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVILKGSKKISDRVILFDEYDSSRHKYDPDYYIHNQVLPAVLRILEAFGFKEKDLKYQRMKQTGLGAWLKMGKK

SEQ ID NO: 619 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 620 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVKLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 621 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 622 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYIEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 623 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHELITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 624 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 625 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITSRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 626 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLASVVRHIIHLPTYTLEAVYEAVFGKKKEKVYAEEIAEAWKSEEGLKCVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 627 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETLAKVLEVILREGSIEKAAGIVKKVVEDLANYRVPVEKLIIHEQITRELKDYKATGPHVAITKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 628 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGERFAVEVKGRIHLDLAPVARHTIRLPTYTLEAVYEAVFGKKKEKVYAEEIAEAWKNEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 629 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDSPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 630 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 631 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVTRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 632 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKDTQAKVLEVILREGSIEKTAGIVKKVVEDLASYRVPVEKLIIHEQITRELKDYKATGPHVAIAKRLQARGIKVKPGTIISYVVLIGSKKISDRVILFDEYDSSRHKYDPDYYIHNQVLPAVLCILEAFGYKEKDLEYQRMKQTGLGAWLKMGKK

SEQ ID NO: 633 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 634 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQTRGIKVKPGTIISYVVLKGSNKISDRVILFDEYDSSRHKYDPDYYIHNQVLPAVLRILEAFGYKEKDLEYQRMKQTGLGAWLKMGKK

SEQ ID NO: 635 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPYYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 636 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 637 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFMKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 638 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 639 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 640 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 641 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHVQITRELKDYKATGPHVAIAKRLQARGIKVKPGTIISYVVLKGCKKISDRVILFDEYDSSRHKYDPDYYIHNQVLPAVLRILEAFGYKEKDLEYQRMKQTGLGAWLKMGKK

SEQ ID NO: 642 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELDYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 643 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 644 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIKLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 645 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 646 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIVLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 647 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNADFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 648 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPNDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 649 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQSRGIKVKPGTIISYVVLKGSKKISDRVILFDEYDSSRHLYDPDYYIHNQVLPAVLRILEAFGYKEKDLEYQRMKQTGLGAWLKMGKK

SEQ ID NO: 650 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 651 - protein, 773 aa, synthetic construct; identical to SEQ ID NO: 598
  REGION 1..773: note = Description of Artificial Sequence: Synthetic polypeptide

SEQ ID NO: 652 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAHIKKRCEKLGLKFTIGRDGSEPKIQRMGDRFAVEVKGRIHLDLAPVVRHTIRLPTYTLEAVYEAVFGKEKEKVYAEEIAGAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 653 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 654 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 655 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRTGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 656 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTITLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 657 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLKILEAFGYKEKDLEYQRMKQTGLGAWLKMGKK

SEQ ID NO: 658 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILVAFGYKEKDLEYQRMKQTGLGAWLKMGKK

SEQ ID NO: 659 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTSNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 660 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMERARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 661 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 662 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 663 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKASGPHVAIAKRLLARSIKVKPGTIISYVVLKGSKKISDRVILFDEYDSSRHKYDPDYYIHNQVLPVVLRILEAFGYKEKDLEYQRMKQTGLGAWLKMGKK

SEQ ID NO: 664 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 665 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 666 - protein, 619 aa, synthetic construct
  REGION 1..619: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEVAK

SEQ ID NO: 667 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 668 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVIMREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 669 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKFLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 670 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 671 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQASMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 672 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQESMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 673 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 674 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRWDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 675 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLNGSKKISDRVILFDEYDSSRHKYDPDYYIHNQVLPAVLRILEAFGYKEKDLEYQRMKQTGLGAWLKMGKK

SEQ ID NO: 676 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPYYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 677 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPSYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 678 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTFGRDGSEPKIQRMGDRFAVEVKGRIHLDLAPVVRHTIRLPTYTLEVVYEAVFGKKKEKVYAEEIAEAWKSEEGLKRVAQYSMEDACATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 679 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPQVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 680 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDSDYYIHNQVLPAVLRILEAFGYKEKDLEYQRMKQTGLGAWLKMGKK

SEQ ID NO: 681 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEEDLEYQRMKQTGLGAWLKMGKK

SEQ ID NO: 682 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRTGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 683 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGSIISYVVLKGSKKISDRVILFDEYDSSRHKYDPDYYIHNQVLPAVLRILEAFGYKEKDLEYQRMKQTGLGAWLKMGKK

SEQ ID NO: 684 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSSECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 685 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATFELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 686 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRRLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 687 - protein, 773 aa, synthetic construct; identical to SEQ ID NO: 412
  REGION 1..773: note = Description of Artificial Sequence: Synthetic polypeptide

SEQ ID NO: 688 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 689 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPVVLRILEAFGYKEKDLEYQRMKQTGLGAWLKMGKK

SEQ ID NO: 690 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEANKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 691 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIIGYVVLKGSKKISDRVILFDEYDSSRHKYDPDYYIHNQVLPAVLRILEAFGYKEKDLEYQRMKQTGLGAWLKMGKK

SEQ ID NO: 692 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 693 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVQRILEAFGYKEKDLEYQRMKQTGLGAWLKMGKK

SEQ ID NO: 694 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARSIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 695 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 696 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKRISDRVILFDEYDSSRHKYDPDYYIHNQVLPAVLRILEAFGYKEKDLEYQRMKQTGLGAWLKMGKK

SEQ ID NO: 697 - protein, 757 aa, synthetic construct; identical to SEQ ID NO: 327
  REGION 1..757: note = Description of Artificial Sequence: Synthetic polypeptide

SEQ ID NO: 698 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 699 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 700 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHMAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 701 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 702 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILVAFGYKEKDLEYQRMKQTGLGAWLKMGKK

SEQ ID NO: 703 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPEIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 704 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 705 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 706 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKKKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 707 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 708 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 709 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKTKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 710 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYNEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 711 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQASGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 712 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANMRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 713 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 714 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKKKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 715 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 716 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 717 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSSECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 718 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKTKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 719 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 720 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 721 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEEDLEYQRMKQTGLGAWLKMGKK

SEQ ID NO: 722 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLLARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 723 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGVKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 724 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHELITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 725 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANLRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 726 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALMILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 727 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVWAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 728 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIYTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 729 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRMDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 730 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 731 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 732 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSGIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 733 - protein, 773 aa, synthetic construct
  REGION 1..773: note = Description of Artificial Sequence: Synthetic polypeptide
MILDTDYITESGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 734 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 735 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRGDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 736 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 737 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 738 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIKTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 739 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHGQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 740 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 741 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 742 - protein, 615 aa, synthetic construct
  REGION 1..615: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWS

SEQ ID NO: 743 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 744 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 745 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 746 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRTLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 747 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 748 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 749 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVEVAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 750 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 751 - protein, 464 aa, synthetic construct
  REGION 1..464: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVK

SEQ ID NO: 752 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 753 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLVNYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 754 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHAQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 755 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 756 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSNAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 757 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 758 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKKTGERHGKKVRIIRVEKVKKKFLGEPIEVWKLVFEHPQDVPAIRDAIRSHPAVREIFEYDIPFAKRYLIDKGLVPMEGGEELKLPAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 759 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 760 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 761 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRSWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 762 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKKYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 763 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 764 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 765 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPFYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 766 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIITTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 767 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRFDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 768 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 769 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDWFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 770 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 771 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAILTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 772 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 773 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 774 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 775 - protein, 773 aa, synthetic construct
  REGION 1..773: note = Description of Artificial Sequence: Synthetic polypeptide
MILDTDYITKNGKPVIHIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFCHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 776 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 777 - protein, 773 aa, synthetic construct
  REGION 1..773: note = Description of Artificial Sequence: Synthetic polypeptide
MILDTDYITENGKPVIRIFKKEKGEFKIEYDRNFEAYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 778 - protein, 773 aa, synthetic construct
  REGION 1..773: note = Description of Artificial Sequence: Synthetic polypeptide
MILDTDYITENGKPVIRIFKKEMGEFKIEYDRNFEPYIYALLEDDESIEDIKKITGERHGKKVRIIRMEKVKKKFLGEPIEVWRLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 779 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRPLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 780 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVHKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 781 - protein, 773 aa, synthetic construct; identical to SEQ ID NO: 497
  REGION 1..773: note = Description of Artificial Sequence: Synthetic polypeptide

SEQ ID NO: 782 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFLPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 783 - protein, 773 aa, synthetic construct
  REGION 1..773: note = Description of Artificial Sequence: Synthetic polypeptide
MILDTDYITENGKPVIRIFKKEKGEFKIEYDRSFEPYIYVLLEDDESIEDIKKITVERHGKKVRIIRVEKVKKKFQGEPIEVWKLVFEHPQDVPAIRDAIRSYPAVREIFEYDIPFAKRYLFDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 784 - protein, 773 aa, synthetic construct
  REGION 1..773: note = Description of Artificial Sequence: Synthetic polypeptide
MILDTDYITENGKPVIRIFKKEKGEFKIEYDRNFEPNIYALLEDDESIEDIKKITGERHGKKVRIIRVEKVKKKFLGEPIEVWKLVIEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 785 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVRVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 786 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPHYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 787 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRHDWSGIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 788 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPLYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 789 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLVDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 790 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDGPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 791 - protein, 773 aa, synthetic construct; identical to SEQ ID NO: 193
  REGION 1..773: note = Description of Artificial Sequence: Synthetic polypeptide

SEQ ID NO: 792 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFYIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 793 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSQPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 794 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPLDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 795 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 796 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 797 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDVRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 798 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 799 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLALAIATFYHEGDEFAEGEILMISYADESGAKVITWKKIDLPYVEVVSTEREAIKRFLQVLREKDPDVLLTYNGDNFDFAYIKKRCEKLGLKFTIGCDGSEPKIQRMDDRFAVEVKGRIHLDLAPVIRHTIRLPTYTLEAVYEAVFGKKKGKVYAEEIAEAWKSEEGLKRVAQYSMEDARATYELGREFFPMEVGLAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 800 - protein, 773 aa, synthetic construct
  REGION 1..773: note = Description of Artificial Sequence: Synthetic polypeptide
MILDTDYITENGKPVIRIFKKEKGEFKIEYDRNFETYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 801 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIVTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 802 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRIDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 803 - protein, 773 aa, synthetic construct; identical to SEQ ID NO: 547
  REGION 1..773: note = Description of Artificial Sequence: Synthetic polypeptide

SEQ ID NO: 804 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 805 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRHDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 806 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 807 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPKYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 808 - protein, 761 aa, synthetic construct
  REGION 1..761: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQ

SEQ ID NO: 809 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 810 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTILLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 811 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVECLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 812 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRTLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 813 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDEFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 814 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 815 - protein, 463 aa, synthetic construct
  REGION 1..463: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKV

SEQ ID NO: 816 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVMRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 817 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYRATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 818 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDFRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 819 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVECLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 820 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDEVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 821 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKDTQAKVLEVILRGGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHYQVLPAVLRILEAFGYKEKDLEYQRMKQTGLGAWLKMGKK

SEQ ID NO: 822 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 823 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRSDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 824 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 825 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPWYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 826 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 827 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPSEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 828 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKTLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 829 - protein, 773 aa, synthetic construct
  REGION 1..773: note = Description of Artificial Sequence: Synthetic polypeptide
MILDTDYITVNGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 830 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 831 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGGEPKIQRMGDRFAVEVKGRIHLDLAPVVRHTIRLPTYTLEAVYEAVLGKKKEKVYAEEIAEAWKSEEGLKRVAQFSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 832 - protein, 773 aa, synthetic construct
  REGION 1..773: note = Description of Artificial Sequence: Synthetic polypeptide
MILDTDYITKNGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKCYLIDKGLVPMEGGEELELLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 833 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPEYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 834 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAINTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 835 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 836 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKAYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 837 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 838 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 839 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 840 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 841 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 842 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVEAAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 843 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 844 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 845 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 846 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 847 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 848 - protein, 773 aa, synthetic construct
  REGION 1..773: note = Description of Artificial Sequence: Synthetic polypeptide
MILDTDYITENGKPVTRIFKKEKGEFKIEYDRNFEPYIYALLEDDESIEDIKKITGERHGKKVRIIRVEKVKKKFLGEPIEVWKLVCEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 849 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSTIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 850 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTARLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 851 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKAYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 852 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVEIAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 853 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 854 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVHKKFLGEPIEVWKLVFEHPQDVPAIRDAIRSHPAVREIFEYDIPFAKHYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 855 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 856 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHAFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 857 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 858 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 859 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFFLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 860 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKCTQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 861 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 862 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSCIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 863 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 864 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 865 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 866 - protein, 773 aa, synthetic construct
  REGION 1..773: note = Description of Artificial Sequence: Synthetic polypeptide
MILDTDYITENGKPVIRIFKKEKGEFKIEYDRNFEKYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 867 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 868 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELSDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 869 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 870 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHELITRELRDYKATGPHVAIAKRLQARGVKVKPGTIISYVVLNGSKKISDRVILFDEYDSSRHKYDPDYYIHNQVLPAVLRILEAFGYKEKDLEYQRMKQTGLGAWLKMGKK

SEQ ID NO: 871 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILTDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 872 - protein, 773 aa, synthetic construct
  REGION 1..773: note = Description of Artificial Sequence: Synthetic polypeptide
MILDTDYITENGKPVICIFKKEKGEFKIEYDRNFEPYIYTLLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 873 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 874 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPRYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 875 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKISRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 876 - protein, 773 aa, synthetic construct
  REGION 1..773: note = Description of Artificial Sequence: Synthetic polypeptide
MILDTDYITENGKPVTRIFKKEKGKFKIEYDRNFEPYIYALLEDDESIENIKKITGERYGKKVRIIRVEKVKKKFLGEPIEVWKLVFEHPQDAPAIRDAIRSHPAVREIFEYDIPFAKRYLIDKGQVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 877 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDKPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 878 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 879 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKNYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 880 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKKYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 881 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPWEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 882 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLVDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 883 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFIASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 884 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 885 - protein, 773 aa, synthetic construct
  REGION 1..773: note = Description of Artificial Sequence: Synthetic polypeptide
MILDTDYITENGKPVIRIFKKEKGEFKIEYDRSFEPYIYALLEDDESIEDIKKITGERHGKKVRIICVEKVKKKFLGEPIVVWKLVFEHPQDVPAIRDATRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 886 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKMLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 887 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMLSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 888 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 889 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFLIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 890 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKMYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 891 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 892 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKFTGERHGKKVRIIRVEKVKKKFLGEPFEVWKLVFEHPQDVPAIRDAIRSHPSVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 893 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFIIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 894 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILNDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 895 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 896 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 897 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPCYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 898 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 899 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSNDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 900 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 901 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIFTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 902 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNVDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 903 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVLEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 904 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 905 - protein, 773 aa, synthetic construct
  REGION 1..773: note = Description of Artificial Sequence: Synthetic polypeptide
MILDTDYITENGKPVIRIFKKEKSEFKIEYDRNFEPYIYALLEDDESIEDIKKITGERHGKKVRIIRVEKVKKKFLGEPIEVWKLVFEHPQDVPAIRDAIRSHPAVREIFEYDIPFAKCYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 906 - protein, 773 aa, synthetic construct
  REGION 1..773: note = Description of Artificial Sequence: Synthetic polypeptide
MILNTDYITENGKPVIRIFKKEKGEFKIEYDRNFEPYIYALLEDDESIEDIKKITGERHGKKVRIIRVEKVKKKFLSEPIEVWKLVFEHPQDVPASRDAIRSHLAVREIFEYDIPFAKRYLIDKGLMPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 907 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 908 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVYAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 909 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPNYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 910 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKCKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 911 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALRILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 912 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 913 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 914 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLRARGIKVKPGTIISYVVLKGSKKISDRVILFDEYDSSRHKYDPDYYIHNQVLPAVLRILEAFGYKEKDLEYHRMKQTGLGAWLKMGKK

SEQ ID NO: 915 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 916 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFFIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 917 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 918 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFVIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 919 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRMDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 920 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPWDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 921 - protein, 773 aa, synthetic construct; identical to SEQ ID NO: 383
  REGION 1..773: note = Description of Artificial Sequence: Synthetic polypeptide

SEQ ID NO: 922 - protein, 773 aa, synthetic construct
  REGION 1..773: note = Description of Artificial Sequence: Synthetic polypeptide
MILDTSYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSRIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHSAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 923 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDARQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 924 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPHDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 925 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKTTGPHVAIAKRLQARDIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 926 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAMYEAVFGKKKKKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 927 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKVLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 928 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDISFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 929 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGCEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 930 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGECHGKKVRIIRVEKVKKKFLGEPIEVWKLVFEHPQDVPAIRDAIRSHPAVREFFEYDIPFAKRYLIDRGLVPMEGGKELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 931 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILDDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 932 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAGFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 933 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPEIQRMGDRFAVEVKGRIHLDLTLVVRHTIRLPTYTLEAVYEAVFGKKKEKVYTEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 934 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRGLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 935 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQCRGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 936 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHLQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 937 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWFRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 938 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFMASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 939 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRDLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 940 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 941 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAGSIIVTHNVSPDTLEKECKNYDVAPIVGYRFCKDFKGFIPSILEDLIETRQKVKRKMKATIDPIEKKMLDYRQRSLKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 942 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIITFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 943 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDCRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 944 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 945 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLMPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 946 - protein, 773 aa, synthetic construct; identical to SEQ ID NO: 193
  REGION 1..773: note = Description of Artificial Sequence: Synthetic polypeptide

SEQ ID NO: 947 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRNDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 948 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEALFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 949 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSNNPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 950 - protein, 773 aa, synthetic construct; identical to SEQ ID NO: 476
  REGION 1..773: note = Description of Artificial Sequence: Synthetic polypeptide

SEQ ID NO: 951 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAHIKKRSEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 952 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVGAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 953 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDGPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 954 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSGPSIIVTHNVSPDTLEKECKNYDVAPIVGYRFCKDFKGFIPSILEDLIETRQKVKRKMKATIDPIEKKMLDYRQRALKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 955 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHWIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 956 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYSATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 957 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEAWKAVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 958 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDAPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 959 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHFYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 960 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSYGVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 961 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSGKISDRVILFDEYDSSRHKYDPDYYIHNQVLPAVLRILEAFGYKEKDLEYQRMKQTGLGAWLKMGKK

SEQ ID NO: 962 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSYPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 963 - protein, 474 aa, synthetic construct
  REGION 1..474: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPI

SEQ ID NO: 964 - protein, 773 aa, synthetic construct; identical to SEQ ID NO: 648
  REGION 1..773: note = Description of Artificial Sequence: Synthetic polypeptide

SEQ ID NO: 965 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAPSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 966 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 967 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFILSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 968 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGECHGKKVRFIRVEKVKKKFLGEPIEVWKLVFEHPQDVPAIRDAIRSHPAVCEIFEYDIPFAKRYLIDKGLVPLEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 969 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHVQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 970 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFGISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 971 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEQVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 972 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRNLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 973 - protein, 772 aa, synthetic construct
  REGION 1..772: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 974 - protein, 773 aa, synthetic construct
  REGION 1..773: note = Description of Artificial Sequence: Synthetic polypeptide
MILDTSFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFAASIIVTHNVSPDTLEKECRNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHSQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 975 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 976 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALNILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 977 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 978 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAVSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 979 - protein, 773 aa, synthetic construct
  REGION 1..773: note = Description of Artificial Sequence: Synthetic polypeptide
MILDTDYITENGKPVIRIFKKEKGEFKIEYDRNFEVYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 980 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLGASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 981 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGLRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 982 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 983 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQCRGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 984 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPCEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 985 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 986 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIHDAIRSHPAVREILEYDIPFAKRYLIDKGLVPVEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 987 - protein, 773 aa, synthetic construct
  REGION 1..773: note = Description of Artificial Sequence: Synthetic polypeptide
MILATDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVAVKGRIHLDLAPVVRHTIRLPTYTLEAVYEAVFGKKKEKVYAEEIAEAWKSEEGLKRVAQYSMEDARATYELGREFFPMEVELAKLIGQSVWAVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 988 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANGYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 989 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 990 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAISIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 991 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHMWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 992 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 993 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKALANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 994 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPLDAPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 995 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 996 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYYATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 997 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQCKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 998 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRRSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 999 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEATFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1000 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1001 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHVYRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1002 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVVPGTIISYVVLKGSKKISDRVILFDEYDSSRHKYDPDYYIHNQVLPAVLRILEAFGYKEKDLEYQRMKQTGLGAWLKMGKK

SEQ ID NO: 1003 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTWRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1004 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFLASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1005 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPRYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1006 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFLASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIAKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1007 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVCRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1008 - protein, 773 aa, synthetic construct; identical to SEQ ID NO: 411
  REGION 1..773: note = Description of Artificial Sequence: Synthetic polypeptide

SEQ ID NO: 1009 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1010 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSILPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1011 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHTQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1012 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKSYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1013 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKLSDRVILFDEYDSSRHKYDPDYYIHNQVLPAVLRILEAFGYKEKDLEYQRMKQTGLGAWLKMGKK

SEQ ID NO: 1014 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1015 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1016 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFIPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1017 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1018 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTVRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDTRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1019 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRALKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1020 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFNASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1021 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDTPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1022 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEGDESIEDIKKITGERLGKKVRIIRVEKVKKKFLGEPIEVRKLVFEHPQDVPAIRDAIRSHPAVREIFEYDTPFTKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1023 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDWRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1024 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRSLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1025 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSTEKAAGIVKKVVEGLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1026 - protein, 480 aa, synthetic construct
  REGION 1..480: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLD

SEQ ID NO: 1027 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIRTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1028 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHYMRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1029 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSFTPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1030 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKGYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1031 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1032 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1033 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSITPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1034 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDSPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1035 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRLDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1036 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPCEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1037 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRMLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1038 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAASIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1039 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLYPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRALKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1040 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGRRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1041 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPICKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1042 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKSLANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1043 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLDPSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1044 - protein, 773 aa, synthetic construct
  REGION 1..773: note = Description of Artificial Sequence: Synthetic polypeptide
MILDTDYITENGKPVIRIFKKKKGEFKIEYDRNFEPYIYALLEDDESIEDIKKITGERHGKKVRIIRVEKVKKKFLGEPIEVWKQVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1045 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSAAASIIVTHNVSPDTLEKECKNYDVAPIVGYRFCKDFKGFIPSILEDLIETRQKVKRKMKATIDPIEKKMLDYRQRSLKILANGIYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1046 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEVAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLCARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1047 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIINTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1048 - protein, 773 aa, synthetic construct
  REGION 1..773: note = Description of Artificial Sequence: Synthetic polypeptide
MILDTDYITENGKPVIRIFEKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFTKRYLIDKGLVPMESGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRSLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1049 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1050 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANFRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1051 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRGLYPGIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1052 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1053 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAERVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1054 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKSGKK

SEQ ID NO: 1055 - protein, 755 aa, synthetic construct
  REGION 1..755: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLE

SEQ ID NO: 1056 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAERVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1057 - protein, 766 aa, synthetic construct
  REGION 1..766: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGA

SEQ ID NO: 1058 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1059 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRYWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1060 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRMEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1061 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1062 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRLEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1063 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPSEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1064 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1065 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEKVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1066 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1067 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRREWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1068 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1069 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKESAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1070 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILAASYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1071 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1072 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1073 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRTKQTGLGAWLKMGKK

SEQ ID NO: 1074 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1075 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKSLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1076 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSISPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1077 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1078 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESLTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1079 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEWVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1080 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIELSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1081 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1082 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1083 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRAWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1084 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPAIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1085 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWVRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1086 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRSKQTGLGAWLKMGKK

SEQ ID NO: 1087 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRSKQTGLGAWLKMGKK

SEQ ID NO: 1088 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKRLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1089 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYTSIIVTHNVSPDTLEKECKNYDVAPIVGYRFCKDFKGFIPSILEDLIETRQKVKRKMKATIDPIEKKMLDYRQRLLKILAISYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1090 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIIKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1091 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEHVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1092 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1093 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1094 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1095 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEKQRMKQTGLGAWLKMGKK

SEQ ID NO: 1096 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYSSIIVTHNVSPDTLEKECKNYDVAPIVGYRFCKDFKGFIPSILEDLIETRQKVKRKMKATIDPIEKKMLDYRQRLLKILAASYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1097 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1098 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAFLKMGKK

SEQ ID NO: 1099 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILATSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1100 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMSDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1101 - protein, 755 aa, synthetic construct
  REGION 1..755: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLE

SEQ ID NO: 1102 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAEEVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1103 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYTKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1104 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1105 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1106 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1107 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAILRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1108 - protein, 758 aa, synthetic construct
  REGION 1..758: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQR

SEQ ID NO: 1109 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1110 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1111 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEWVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1112 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESLTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1113 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAYLKMGKK

SEQ ID NO: 1114 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGASLKMGKK

SEQ ID NO: 1115 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKNGKK

SEQ ID NO: 1116 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYWGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1117 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSITPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1118 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEQQRMKQTGLGAWLKMGKK

SEQ ID NO: 1119 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYLKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1120 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1121 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWARHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1122 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEWVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1123 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1124 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEKVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1125 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1126 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYASIIVTHNVSPDTLEKECKNYDVAPIVGYRFCKDFKGFIPSILEDLIETRQKVKRKMKATIDPIEKKMLDYRQRLLKILATSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1127 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1128 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1129 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRFWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1130 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRVEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1131 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEQQRMKQTGLGAWLKMGKK

SEQ ID NO: 1132 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEHAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1133 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRRWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1134 - protein, 757 aa, synthetic construct
  REGION 1..757: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQ

SEQ ID NO: 1135 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWARHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1136 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1137 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPNEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1138 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAINTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1139 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDFPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLARVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1140 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYRKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1141 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1142 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRNKQTGLGAWLKMGKK

SEQ ID NO: 1143 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1144 - protein, 769 aa, synthetic construct
  REGION 1..769: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLK

SEQ ID NO: 1145 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAYLKMGKK

SEQ ID NO: 1146 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1147 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEANKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1148 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRKLKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1149 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWSRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1150 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1151 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEHVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1152 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRKEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1153 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWTRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1154 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRSWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1155 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPREVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1156 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYMGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1157 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1158 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1159 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANCRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1160 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYAKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1161 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKTGKK

SEQ ID NO: 1162 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMKDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1163 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRNWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1164 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKKLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1165 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1166 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRALYPAIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1167 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1168 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPNEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1169 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRFWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1170 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMNDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1171 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSILPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1172 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1173 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1174 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESISAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1175 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1176 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESMTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1177 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFNVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1178 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1179 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1180 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRREWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1181 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKTGKK

SEQ ID NO: 1182 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRPEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1183 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILASSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1184 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKNGKK

SEQ ID NO: 1185 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESMTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1186 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1187 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1188 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWVRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1189 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWVRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1190 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRAWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1191 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRNKQTGLGAWLKMGKK

SEQ ID NO: 1192 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFSVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1193 - protein, 773 aa, synthetic construct; identical to SEQ ID NO: 331
  REGION 1..773: note = Description of Artificial Sequence: Synthetic polypeptide

SEQ ID NO: 1194 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILAASYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1195 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMKDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1196 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESATAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1197 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKSGKK

SEQ ID NO: 1198 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESMSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1199 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRVWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1200 - protein, 766 aa, synthetic construct
  REGION 1..766: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGA

SEQ ID NO: 1201 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1202 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKRLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1203 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRAEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1204 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWTRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1205 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAIERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1206 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1207 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEHVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1208 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1209 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1210 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEKVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1211 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRDEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1212 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLTNYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1213 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMNDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1214 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSITPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1215 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1216 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1217 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYVSIIVTHNVSPDTLEKECKNYDVAPIVGYRFCKDFKGFIPSILEDLIETRQKVKRKMKATIDPIEKKMLDYRQRLLKILASSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1218 - protein, 758 aa, synthetic construct
  REGION 1..758: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQR

SEQ ID NO: 1219 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLASIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1220 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1221 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1222 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESFSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1223 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIVTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1224 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWSRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1225 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIAPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1226 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEGWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1227 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILASSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1228 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1229 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1230 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIVTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1231 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESITAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1232 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAERVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1233 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFSVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1234 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1235 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILAISYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1236 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRYWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1237 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEALFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1238 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSWYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1239 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEMAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1240 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1241 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1242 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRSEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1243 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVIAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1244 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYFGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1245 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNINTFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1246 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKNLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1247 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMRDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1248 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1249 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWTRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1250 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFNIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1251 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRNWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1252 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRRWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1253 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLVSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1254 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESITAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1255 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFRVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1256 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1257 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPSEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1258 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1259 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPKEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1260 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKNLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1261 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPREVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1262 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1263 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSISPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1264 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRVWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1265 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAFLKMGKK

SEQ ID NO: 1266 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYRKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1267 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPKEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1268 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKKLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1269 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAHLKMGKK

SEQ ID NO: 1270 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYAKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1271 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWSRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1272 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESFTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1273 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1274 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNISPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1275 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRKWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1276 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVLPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1277 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEDAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1278 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESSTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1279 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRNEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1280 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLSSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1281 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLSPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1282 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVVAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1283 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRQWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1284 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYNGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1285 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSVIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1286 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRQWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1287 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEQAEFVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1288 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESLSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1289 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSVDPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1290 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIEPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1291 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1292 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPGIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1293 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRTKQTGLGAWLKMGKK

SEQ ID NO: 1294 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILATSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1295 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRKWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1296 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIVPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1297 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKSLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1298 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEALFGKKKEKVYAEEIAEAWKSEEGLKRVAQYSMEDARATYELGREFFPLEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1299 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILAISYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1300 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAHLKMGKK

SEQ ID NO: 1301 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLLTSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1302 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKENAEDVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1303 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWARHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1304 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYTKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1305 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIMPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVAAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1306 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKEAAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1307 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRALYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1308 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSIFPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1309 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRGLYPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1310 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGASLKMGKK

SEQ ID NO: 1311 - protein, 769 aa, synthetic construct
  REGION 1..769: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLK

SEQ ID NO: 1312 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSILPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESVSAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1313 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLTPSIIVTHNVSPDTLEKECKNYDVAPIVGYRFCKDFKGFIPSILEDLIETRQKVKRKMKATIDPIEKKMLDYRQRLLKILANSYYGYQGYPKARWYSKECAESFTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1314 - protein, 773 aa, synthetic construct
  REGION 1..773: note = Description of Artificial Sequence: Synthetic polypeptide
MILDTDFITENGKPVIRIFKKEKGEFKIEYDRNFEPYIYALLEDDESIEDIKKITGERHGKKVRIIRVEKVKKKFLGEPIEVWKLVFEHPQDVPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSLYPSIIVTHNVSPDTLEKECKNYDVAPIVGYRFCKDFKGFIPSILEDLIETRQKVKRKMKATIDPIEKKMLDYRQRLLKILANSFYGYQGYPKARWYSKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKDYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1315 - protein, 773 aa, synthetic construct
  REGION 1..773: note = Description of Artificial Sequence: Synthetic polypeptide
MILDTDYITENGKPVIRIFKKEKGEFKIEYDRNFEPYIYALLEDDESIEDIKKITGERHGKKVRIIRVEKVKKKFLGEPIEVWKLVFEHPQDYPAIRDAIRSHPAVREIFEYDIPFAKRYLIDKGLVPMEGGEELKLLAFAIATFYHEGDEFAEGEILMISYADESGAKVITWKKIDLPYVEVVSTEREAIKRFLQVLREKDPDVLLTYNGDNFDFAYIKKRCEKLGLKFTIGRDGSEPKIQRMGDRFAVEVKGRIHLDLAPVVRHTIRLPTYTLEAVYEAVFGKKKEKVYAEEIAEAWKSEEGLKRVAQYSMEDARATYELGREFFPMEVELAKLIGQSVWDVSRSSTGNLVEWYLLRVAYERNELAPNKPGGEEYQRRMRSSYIGGYVKEPEKGLWESIAYLDFRSSAGSIIVTHNVSPDTLEKECKNYDVAPIVGYRFCKDFKGFIPSILEDLIETRQKVKRKMKATIDPIEKKMLDYRQRALKILANSYYGYQGYPKARWYLKECAESVTAWGRHYIETTIKEAEKFGFKVLYADTDGFFATIPNEKPETIKSKAKKFLKHINEKLPGMLELEYEGFYLRGFFVTKKKYALIDEDGHITTRGLEVVRRDWSEIAKETQAKVLEVILREGSIEKAAGIVKKVVEDLANYRVPVEKLIIHEQITRELKRYKATGPHVAIAKRLQARGIKVKPGTIISYVVLKGSKKISDRVILFDEYDSSRHKYDPDYYIHNQVLPAVLRILEAFGYKEKDLEYQRMKQTGLGAWLKMGKK

SEQ ID NO: 1316 - protein, 792 aa, unidentified
  REGION 1..792: note = Description of Unknown: Euryarchaeota archaeon sequence
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVDIEVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1317 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1318 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1319 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1320 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1321 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1322 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1323 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1324 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1325 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1326 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1327 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1328 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1329 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1330 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1331 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEVLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1332 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESSAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1333 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKERLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1334 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1335 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSHGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1336 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLESVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1337 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEERAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1338 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYVKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1339 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1340 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1341 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTLLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1342 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1343 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1344 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1345 - protein, 784 aa, synthetic construct
  REGION 1..784: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGIT

SEQ ID NO: 1346 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRRR

SEQ ID NO: 1347 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1348 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1349 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWEEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1350 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSIGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1351 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1352 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTRLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1353 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLERVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1354 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSYYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1355 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLRVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1356 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1357 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1358 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1359 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSVGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1360 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFARRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1361 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1362 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1363 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1364 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTRRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1365 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEKVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1366 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRRALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1367 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRGFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1368 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1369 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLELAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1370 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKREKAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1371 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGNIIGYIITKGTKGISQRATPVEFARLEDYDPEYYIDNQILPAIQRIFEAIGYTRDYLKEGITQTSLSRWF

SEQ ID NO: 1372 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESGAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1373 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLNVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1374 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPKVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1375 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1376 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRAFGPAIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1377 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRRR

SEQ ID NO: 1378 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPNVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1379 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLATYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1380 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLDLAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1381 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1382 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPGIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1383 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIFVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1384 - protein, 776 aa, synthetic construct
  REGION 1..776: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTR

SEQ ID NO: 1385 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1386 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1387 - protein, 791 aa, synthetic construct
  REGION 1..791: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRR

SEQ ID NO: 1388 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLELAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1389 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1390 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLKVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1391 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLATYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1392 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESAAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1393 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFQYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1394 - protein, 722 aa, synthetic construct
  REGION 1..722: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPG

SEQ ID NO: 1395 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRGFGPGIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1396 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLFGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1397 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIENKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1398 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1399 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPSVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1400 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHFDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1401 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSLAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1402 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYAKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1403 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1404 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFARRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1405 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1406 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLQLAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1407 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWNEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1408 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLTTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1409 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRKALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1410 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSILVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1411 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFGRMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1412 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRRALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1413 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1414 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEQKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1415 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFLGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1416 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYLKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1417 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1418 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSYAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1419 - protein, 791 aa, synthetic construct
  REGION 1..791: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRR

SEQ ID NO: 1420 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRNALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1421 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1422 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLFGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1423 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRAFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1424 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1425 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLTTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1426 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFQYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1427 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSVAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1428 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIENKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1429 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSIIVSHNIDPSTLIVGNCEENRAPELEYCFSLEREGFIPAILKELIRRRAEIKRELKRSEGDRRRTLSFAEKALKILANSFFGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1430 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPAIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1431 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1432 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1433 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTSLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1434 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLNTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1435 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYRIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1436 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKERLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1437 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSLGPSVIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1438 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTRRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1439 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDIYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1440 - protein, 789 aa, synthetic construct
  REGION 1..789: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLS

SEQ ID NO: 1441 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1442 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1443 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRRALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1444 - protein, 722 aa, synthetic construct
  REGION 1..722: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPG

SEQ ID NO: 1445 - protein, 772 aa, synthetic construct
  REGION 1..772: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAI

SEQ ID NO: 1446 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGTIIGYIITKGTKGISQRATPVEFARLEDYDPEYYIDNQILPAIQRIFEAIGYTRDYLKEGITQTSLSRWF

SEQ ID NO: 1447 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1448 - protein, 781 aa, synthetic construct
  REGION 1..781: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKE

SEQ ID NO: 1449 - protein, 781 aa, synthetic construct; identical to SEQ ID NO: 1448
  REGION 1..781: note = Description of Artificial Sequence: Synthetic polypeptide

SEQ ID NO: 1450 - protein, 781 aa, synthetic construct
  REGION 1..781: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKE

SEQ ID NO: 1451 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGREYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1452 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1453 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1454 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1455 - protein, 792 aa, synthetic construct
  REGION 1..792: note = Description of Artificial Sequence: Synthetic polypeptide
MPRILKGFLIDADIETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1456 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1457 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1458 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1459 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1460 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1461 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVRQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1462 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLKGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1463 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1464 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1465 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANNFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1466 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1467 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1468 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1469 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLLGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1470 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1471 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1472 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVDRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1473 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1474 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1475 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1476 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1477 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1478 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1479 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1480 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1481 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1482 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1483 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSVYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1484 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1485 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRGECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1486 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1487 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1488 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1489 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1490 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1491 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1492 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1493 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVDIEVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1494 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1495 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1496 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1497 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1498 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1499 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKRYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1500 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1501 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1502 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1503 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1504 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1505 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1506 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1507 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1508 - protein, 792 aa, synthetic construct; identical to SEQ ID NO: 1325
  REGION 1..792: note = Description of Artificial Sequence: Synthetic polypeptide

SEQ ID NO: 1509 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1510 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSSYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1511 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1512 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1513 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSIYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1514 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1515 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDAPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1516 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1517 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1518 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1519 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1520 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1521 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1522 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1523 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1524 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1525 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1526 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVFIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1527 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVFQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1528 - protein, 792 aa, synthetic construct; identical to SEQ ID NO: 1318
  REGION 1..792: note = Description of Artificial Sequence: Synthetic polypeptide

SEQ ID NO: 1529 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYVELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1530 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1531 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1532 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1533 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1534 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1535 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1536 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1537 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1538 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1539 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1540 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1541 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1542 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1543 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1544 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1545 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1546 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1547 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1548 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1549 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1550 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1551 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1552 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEREPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1553 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1554 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1555 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1556 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFTASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1557 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGASIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1558 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1559 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1560 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1561 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1562 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1563 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1564 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIFVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1565 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1566 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1567 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1568 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1569 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1570 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1571 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1572 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1573 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1574 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSTYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1575 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1576 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1577 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1578 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1579 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANTFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1580 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLYEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1581 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1582 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1583 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1584 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1585 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1586 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1587 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1588 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1589 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVNRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1590 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1591 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIIVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1592 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1593 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1594 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1595 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1596 - protein, 792 aa, synthetic construct; identical to SEQ ID NO: 1595
  REGION 1..792: note = Description of Artificial Sequence: Synthetic polypeptide

SEQ ID NO: 1597 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1598 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1599 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1600 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1601 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVIIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1602 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1603 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1604 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1605 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEAEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1606 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1607 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGASIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1608 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1609 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1610 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1611 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1612 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1613 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1614 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1615 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1616 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLFGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1617 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1618 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1619 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSSYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1620 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVVQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1621 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1622 - protein, 792 aa, synthetic construct; identical to SEQ ID NO: 1613
  REGION 1..792: note = Description of Artificial Sequence: Synthetic polypeptide

SEQ ID NO: 1623 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1624 - protein, 792 aa, synthetic construct; identical to SEQ ID NO: 1576
  REGION 1..792: note = Description of Artificial Sequence: Synthetic polypeptide

SEQ ID NO: 1625 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1626 - protein, 792 aa, synthetic construct; identical to SEQ ID NO: 1523
  REGION 1..792: note = Description of Artificial Sequence: Synthetic polypeptide

SEQ ID NO: 1627 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1628 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1629 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1630 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1631 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1632 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1633 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1634 - protein, 792 aa, synthetic construct; identical to SEQ ID NO: 1323
  REGION 1..792: note = Description of Artificial Sequence: Synthetic polypeptide

SEQ ID NO: 1635 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1636 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1637 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTYLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1638 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1639 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1640 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1641 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1642 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1643 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAILVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1644 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1645 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1646 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1647 - protein, 792 aa, synthetic construct; identical to SEQ ID NO: 1553
  REGION 1..792: note = Description of Artificial Sequence: Synthetic polypeptide

SEQ ID NO: 1648 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1649 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1650 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRSFKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1651 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1652 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1653 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1654 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRKECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1655 - protein, 792 aa, synthetic construct; identical to SEQ ID NO: 1612
  REGION 1..792: note = Description of Artificial Sequence: Synthetic polypeptide

SEQ ID NO: 1656 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1657 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1658 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVDIEVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1659 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1660 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1661 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1662 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1663 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1664 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1665 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1666 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1667 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTTLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1668 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1669 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1670 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1671 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1672 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1673 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1674 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDRGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1675 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1676 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1677 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1678 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1679 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1680 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1681 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1682 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1683 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRNVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1684 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1685 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEVEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1686 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1687 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1688 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1689 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1690 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1691 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1692 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1693 - protein, 792 aa, synthetic construct; identical to SEQ ID NO: 1668
  REGION 1..792: note = Description of Artificial Sequence: Synthetic polypeptide

SEQ ID NO: 1694 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1695 - protein, 792 aa, synthetic construct; identical to SEQ ID NO: 1324
  REGION 1..792: note = Description of Artificial Sequence: Synthetic polypeptide

SEQ ID NO: 1696 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1697 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1698 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1699 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1700 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1701 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1702 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1703 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1704 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRELAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1705 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1706 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1707 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1708 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1709 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1710 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1711 - protein, 792 aa, synthetic construct; identical to SEQ ID NO: 1542
  REGION 1..792: note = Description of Artificial Sequence: Synthetic polypeptide

SEQ ID NO: 1712 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1713 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1714 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1715 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1716 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1717 - protein, 792 aa, synthetic construct; identical to SEQ ID NO: 1592
  REGION 1..792: note = Description of Artificial Sequence: Synthetic polypeptide

SEQ ID NO: 1718 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1719 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1720 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1721 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1722 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1723 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1724 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1725 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1726 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1727 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1728 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1729 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1730 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1731 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1732 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1733 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1734 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPRIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1735 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1736 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1737 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1738 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1739 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1740 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1741 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1742 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREVAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1743 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1744 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1745 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1746 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1747 - protein, 792 aa, synthetic construct; identical to SEQ ID NO: 1629
  REGION 1..792: note = Description of Artificial Sequence: Synthetic polypeptide

SEQ ID NO: 1748 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1749 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1750 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1751 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1752 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAGSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1753 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1754 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANKFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1755 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFAGSIIVSHNIDPSTLIVGNCEENRAPELEYCFSLEREGFIPAILKELIRRRAEIKRELKRSEGDRRRTLSFAEKLLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1756 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1757 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1758 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1759 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1760 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1761 - protein, 792 aa, synthetic construct; identical to SEQ ID NO: 1470
  REGION 1..792: note = Description of Artificial Sequence: Synthetic polypeptide

SEQ ID NO: 1762 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1763 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1764 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1765 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1766 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1767 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLAKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1768 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRREAAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1769 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1770 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1771 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKKYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1772 - protein, 792 aa, synthetic construct; identical to SEQ ID NO: 1539
  REGION 1..792: note = Description of Artificial Sequence: Synthetic polypeptide

SEQ ID NO: 1773 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1774 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1775 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSAYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1776 - protein, 792 aa, synthetic construct; identical to SEQ ID NO: 1518
  REGION 1..792: note = Description of Artificial Sequence: Synthetic polypeptide

SEQ ID NO: 1777 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDKQILPAIQRIFEAIGYTRDYLKEGITQTSLSRWF

SEQ ID NO: 1778 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1779 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGEMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1780 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSVYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1781 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1782 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1783 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1784 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1785 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1786 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1787 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1788 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1789 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1790 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAASIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1791 - protein, 792 aa, synthetic construct; identical to SEQ ID NO: 1325
  REGION 1..792: note = Description of Artificial Sequence: Synthetic polypeptide

SEQ ID NO: 1792 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1793 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1794 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1795 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1796 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSSAPSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1797 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSAYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1798 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKGLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1799 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1800 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1801 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1802 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1803 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKGELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1804 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKRLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1805 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGRLPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1806 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1807 - protein, 792 aa, synthetic construct; identical to SEQ ID NO: 1456
  REGION 1..792: note = Description of Artificial Sequence: Synthetic polypeptide

SEQ ID NO: 1808 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVGRYLIDRCIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1809 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1810 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1811 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1812 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1813 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1814 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVLQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1815 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKAELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1816 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1817 - protein, 792 aa, synthetic construct; identical to SEQ ID NO: 1457
  REGION 1..792: note = Description of Artificial Sequence: Synthetic polypeptide

SEQ ID NO: 1818 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1819 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVAQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1820 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1821 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1822 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1823 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1824 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1825 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1826 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1827 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1828 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1829 - protein, 792 aa, synthetic construct
  REGION 1..792: note = Description of Artificial Sequence: Synthetic polypeptide
MPRILKGFLIDADYETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVDIEVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1830 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1831 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1832 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1833 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1834 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1835 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANEFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1836 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1837 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1838 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1839 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1840 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1841 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1842 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1843 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1844 - protein, 792 aa, synthetic construct; identical to SEQ ID NO: 1832
  REGION 1..792: note = Description of Artificial Sequence: Synthetic polypeptide

SEQ ID NO: 1845 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDNGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1846 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1847 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSLYPSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1848 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1849 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1850 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1851 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1852 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHYKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1853 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIADEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1854 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANTFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1855 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1856 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1857 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1858 - protein, 792 aa, synthetic construct; identical to SEQ ID NO: 1631
  REGION 1..792: note = Description of Artificial Sequence: Synthetic polypeptide

SEQ ID NO: 1859 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSAYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1860 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1861 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAGSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1862 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSSYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1863 - protein, 792 aa, synthetic construct; identical to SEQ ID NO: 1792
  REGION 1..792: note = Description of Artificial Sequence: Synthetic polypeptide

SEQ ID NO: 1864 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1865 - protein, 792 aa, synthetic construct; identical to SEQ ID NO: 1803
  REGION 1..792: note = Description of Artificial Sequence: Synthetic polypeptide

SEQ ID NO: 1866 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYFQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1867 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1868 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1869 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1870 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1871 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1872 - protein, 792 aa, synthetic construct; identical to SEQ ID NO: 1532
  REGION 1..792: note = Description of Artificial Sequence: Synthetic polypeptide

SEQ ID NO: 1873 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKDYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1874 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1875 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSTYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1876 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDSPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1877 - protein, 792 aa, synthetic construct; identical to SEQ ID NO: 1458
  REGION 1..792: note = Description of Artificial Sequence: Synthetic polypeptide

SEQ ID NO: 1878 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1879 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEKEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1880 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1881 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1882 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1883 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSSYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1884 - protein, 792 aa, synthetic construct; identical to SEQ ID NO: 1321
  REGION 1..792: note = Description of Artificial Sequence: Synthetic polypeptide

SEQ ID NO: 1885 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDDQILPAIQRIFEAIGYTRDYLKEGITQTSLSRWF

SEQ ID NO: 1886 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDFPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1887 - protein, 792 aa, synthetic construct; identical to SEQ ID NO: 1541
  REGION 1..792: note = Description of Artificial Sequence: Synthetic polypeptide

SEQ ID NO: 1888 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFFPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1889 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSAAASIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1890 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1891 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1892 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1893 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELMGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1894 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1895 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1896 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1897 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTFLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1898 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1899 - protein, 792 aa, synthetic construct; identical to SEQ ID NO: 1774
  REGION 1..792: note = Description of Artificial Sequence: Synthetic polypeptide

SEQ ID NO: 1900 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1901 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSYAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1902 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1903 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGASIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1904 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1905 - protein, 792 aa, synthetic construct; identical to SEQ ID NO: 1890
  REGION 1..792: note = Description of Artificial Sequence: Synthetic polypeptide

SEQ ID NO: 1906 - protein, 792 aa, synthetic construct; identical to SEQ ID NO: 1590
  REGION 1..792: note = Description of Artificial Sequence: Synthetic polypeptide

SEQ ID NO: 1907 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1908 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFSPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1909 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1910 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1911 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1912 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1913 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVKQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1914 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1915 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYIELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1916 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYAPSIIVSHNIDPSTLIVGNCEENRAPELEYCFSLEREGFIPAILKELIRRRAEIKRELKRSEGDRRRTLSFAEKSLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1917 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANKFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1918 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1919 - protein, 792 aa, synthetic construct; identical to SEQ ID NO: 1834
  REGION 1..792: note = Description of Artificial Sequence: Synthetic polypeptide

SEQ ID NO: 1920 - protein, 792 aa, synthetic construct; identical to SEQ ID NO: 1656
  REGION 1..792: note = Description of Artificial Sequence: Synthetic polypeptide

SEQ ID NO: 1921 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1922 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1923 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEALLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1924 - protein, 792 aa, synthetic construct; identical to SEQ ID NO: 1511
  REGION 1..792: note = Description of Artificial Sequence: Synthetic polypeptide

SEQ ID NO: 1925 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1926 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLREEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1927 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1928 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSIYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1929 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLFKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1930 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1931 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1932 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1933 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1934 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRAVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1935 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1936 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1937 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEFEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1938 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYSELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1939 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1940 - protein, 792 aa, synthetic construct; identical to SEQ ID NO: 1319
  REGION 1..792: note = Description of Artificial Sequence: Synthetic polypeptide

SEQ ID NO: 1941 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1942 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVKRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1943 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1944 - protein, 792 aa, synthetic construct; identical to SEQ ID NO: 1520
  REGION 1..792: note = Description of Artificial Sequence: Synthetic polypeptide

SEQ ID NO: 1945 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVKRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1946 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVDRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1947 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLAGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1948 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVVIVVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1949 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKAELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1950 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1951 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDPQILPAIQRIFEAIGYTRDYLKEGITQTSLSRWF

SEQ ID NO: 1952 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLVGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1953 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGPSIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1954 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRRVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1955 - protein, 792 aa, synthetic construct; identical to SEQ ID NO: 1947
  REGION 1..792: note = Description of Artificial Sequence: Synthetic polypeptide

SEQ ID NO: 1956 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYREECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1957 - protein, 792 aa, synthetic construct
  REGION 1..792: note = Description of Artificial Sequence: Synthetic polypeptide
MPRILKGFLIDADNETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFYPAILKELIRRRAEIKTELKRSEGDRRRTLSFAEKALKILANSFYGYMGYPRARWYRRECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1958 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1959 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLNEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1960 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKVLKILANSFYGYMGYPRARWYRGECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1961 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPIYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKRELKRSEGDRRRTLSFAEKALKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1962 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYLELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRRECAESVAAFARMYIKQVMRIANEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1963 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVSRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHIKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKALKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1964 - protein, 792 aa, synthetic construct
  REGION 1..792: note = Description of Artificial Sequence: Synthetic polypeptide
MPRILKGFLIDADFETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSYGASIIVSHNIDPSTLIVGNCEENRAPELEYCFSLEREGFIPAILKELIRRRAEIKRELKRSEGDRRRTLSFAEKTLKILANSFYGYMGYPRARWYRRECAESVAAFARMYIKQVMRIAEEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

SEQ ID NO: 1965 - protein, 792 aa, synthetic construct
  REGION 1..792: note = Description of Artificial Sequence: Synthetic polypeptide
MPRILKGFLIDADDETVEGRALIRLFLRGEEGSFVVYDDSFSPYFYALPGDEPERVKERILASGAAEAIQKVEIEEKRLFGTPRVALRITVSHPQDVPRIRERIRRVEGVDLILEHDILFVRRYLIDRGIKPLTWLRLEVEERDGRALLRGVEQLEEEPPELRVAAVAIAVYNPKGAPRSSKDEIIMISVATSDGVEKVLTWREVQGLEQVEVLQDEKEMLLRFAELIKEGDYDVIVGYNTDSFDFPYIRDRLKKLGISLPLGRLDAELEVSRRGALPEARIRGRAHVDLYPIVRRHVKLNSYVLESVVEELLGIKKEKLDGERLFTYWDEGGEKRALLARYALEDARVTLALAEKFLPLYCELSTIVGQSLNDVARMTSGQLVEWLLMRYATPRGELIPNHPAGEEYAARARATYAGGYVREPKRGLVEHIAVFDFRSFGPSIIVSHNIDPSTLIVGNCEENRAPELEYCFSLEREGFIPAILKELIRRRAEIKTELKRSEGDRRRTLSFAEKTLKILANSFYGYMGYPRARWYRSECAESVAAFARMYIKQVMRIAKEEFKLEVVYGDTDSLFVVIPPEKRELAQKFLQKVNESMPGIIELEFEGFYRRGLFVTKKRYALLSEDGKMVVKGLEFVRRDWAPIARETQKEVLRILLEEADPEKAARLVRDVIERIRQRRVSLEDITIYTQLTKRIKSYKSLEPHVVAAQKLKERGREVAPGMIIGYIITKGTKGISQRATPVEFARLEDYDPEYYIDNQILPAIQRIFEAIGYTRDYLKEGITQTSLSRWF

(The sequence listing continues in the following parts.)

What is claimed:

1. A composition comprising:
   a plurality of engineered polymerases comprising an amino acid sequence that is at least 85% identical to SEQ ID NO:1 and has at least one amino acid substitution: Asp141Ala or Glu143Ala, and
   a plurality of modified nucleotides comprising a removable chain terminating moiety at the 3' carbon position of the sugar group.

2. The composition of claim 1, wherein the removable chain terminating moiety comprises an alkyl group, alkenyl group, alkynyl group, allyl group, aryl group, benzyl group, azide group, azido group, 0-azidomethyl group, amine group, amide group, keto group, isocyanate group, phosphate group, thio group, disulfide group, carbonate group, urea group, silyl or acetal group, and wherein the removable chain terminating moiety is cleavable with a chemical compound to generate an extendible 3'OH moiety on the sugar group.

3. The composition of claim 1, wherein the plurality of modified nucleotides comprise one type of modified nucleotide selected from a group consisting of dATP, dGTP, dCTP, dTTP and dUTP.

4. The composition of claim 1, wherein the plurality of modified nucleotides comprise a mixture of any combination of two or more types of modified nucleotides selected from a group consisting of dATP, dGTP, dCTP, dTTP and/or dUTP.

5. The composition of claim 1, wherein the plurality of modified nucleotides are labeled with a fluorophore.

6. The composition of claim 1, wherein at least one modified nucleotide in the plurality of modified nucleotides lacks a fluorophore label.

7. The composition of claim 1, further comprising a plurality of nucleic acid template molecules, and a plurality of oligonucleotide primers.

8. The composition of claim 7, wherein the plurality of nucleic acid template molecules comprise linear nucleic acid molecules, circular nucleic acid molecules, or a mixture of linear and circular nucleic acid molecules.

9. The composition of claim 7, wherein the plurality of nucleic acid template molecules comprises clonally amplified template molecules.

10. The composition of claim 7, wherein at least one of the nucleic acid template molecules in the plurality of nucleic acid template molecules comprise one copy of a target sequence of interest.

11. The composition of claim 7, wherein at least one of the nucleic acid template molecules in the plurality of nucleic acid template molecules comprise a concatemer having two or more tandem copies of a target sequence of interest.

12. The composition of claim 7, wherein at least one of the nucleic acid template molecules in the plurality of nucleic acid template molecules comprise at least one uracil.

13. The composition of claim 1, further comprising a plurality of catalytic divalent cations that promote polymerase-catalyzed nucleotide incorporation, wherein the catalytic divalent cations comprise magnesium or manganese.

14. The composition of claim 7, wherein the plurality of polymerases, the plurality of nucleic acid template molecules, and the plurality of oligonucleotide primers, form a plurality of complexed polymerases each comprising an engineered polymerase bound to a nucleic acid duplex where the duplex comprises a nucleic acid template molecule hybridized to an oligonucleotide primer.

15. The composition of claim 14, wherein the plurality of nucleic acid template molecules comprise the same target of interest sequence or different target of interest sequences.

16. The composition of claim 14, wherein the plurality of complexed polymerases are immobilized to a coating on the support.

17. The composition of claim 16, wherein the density of the plurality of complexed polymerases immobilized to the coating on the support comprises $10^2$-$10^{12}$ per mm$^2$.

18. The composition of claim 16, wherein the plurality of immobilized complexed polymerases are immobilized to pre-determined sites on the coating.

19. The composition of claim 16, wherein the plurality of immobilized complexed polymerases are immobilized to random sites on the coating.

20. The composition of claim 16, wherein the coating comprises at least one hydrophilic polymer coating layer which comprises unbranched polyethylene glycol (PEG), or wherein the coating comprises at least one hydrophilic polymer coating layer which comprises branched polyethylene glycol (PEG) having at least 4 branches.

21. The composition of claim 16, wherein the hydrophilic polymer coating has a water contact angle of no more than 45 degrees.

22. The composition of claim 1, wherein the plurality of engineered polymerases comprise amino acid substitutions Asp141Ala and Glu143Ala.

* * * * *